United States Patent 9,567,581 (SELECTIVE REACTIVATION OF GENES ON THE INACTIVE X CHROMOSOME) - sequence listing, part 8

SEQ ID NO: 867 - DNA, 127311 bp, mus musculus
cgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtc

SEQ ID NO: 868 - DNA, 127415 bp, mus musculus
cgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctagaaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgtttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtttcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggggagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgcgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaataggttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatggaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaatttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacaacacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagtgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcaacctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtactacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacatttgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgagtacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttatttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggttccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacagtacaacaaaaaataatgcaaataaaagcaatatagtatagcaactatttacacagcatttacattgtattaggtattatgagtaatcttgagatgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagcagct

SEQ ID NO: 869 - DNA, 4 bp, mus musculus
ttcc

SEQ ID NO: 870 - DNA, 217 bp, mus musculus
gggagagctgtggtggggaagaagggtagaggggggaaggcgtccagcaagaacagccgtgttggaggaaacaatggcaggggcaacagcgatggtggcagcagaggcggccccactctgggcacctttctgaatgggcagagacagctccgggagaagaggggaccaggcagtgcctgcagaggctctgagaaaagcggcagagggaggagaagag

SEQ ID NO: 871 - DNA, 11819 bp, mus musculus
tcgaagaaggtgctgggcagccacgggcgccacgcctcagtggccccaattgccgaagccgatctcctgcttgtatctgttagtgaggatgttggctttgcgcgtgagtttcgagagcacagtgtgcagcccgcgcaggtggtagtggaactgctgttccaggtcttcttcgccggcgtccgcaccctccaagtggcccaggtccaccaggatgtccttggacttccaggcactgccctcctcgctcccagccggtggaggcggctggtgcaggaccccccactcgatgtcgttgcggatggacttgagaagcacgtagtggctgtacatgtcccgagagggcgcgaaaaagctgccattggcgcttcccgagtcggggactgggggcgtgcgctcctccaggcagccgccactgccgcctacctccacgccaacatcgttgtctaacccggggtcagccaggggcacgtcgcgcagcaagctgggcaccatcaccgtctggtccatgttgttcacggcgccaatgaagcgattcatggcgttaaagagcgagtgcttctggttgtaggtgtcgcagatttgcatcatggtggccgcgcggacgttggagcgcagggacgcaggggcacggggatggtcggccgggtcaaggggatgcccgccttcacgcgctctccaaggcccgcgctgggggcctggctatagccggtgtggcgggattcccggcactcctccgccctcgccaactctcgtctcgctggcagaccggccctgcgggatgggcggcttctcctggctttggcgcccggaaactcgcgatggctgagggtgctctgtgggtcgagccctggcctgtttgatacacggagacgaaagaacagattagattattcaccctgctagggggcctggcgcccttgcccgcgcgcacccccttctctggctacagctcgtccgggacggcgcctgggtggctccccgcggctgggcagtcccacctcctcgcccacctacggccgcggggagaagggtgtccccccaccaccacaacttctccctccgaaaagcctgagctcaagcaaccaagctggccggggcagcgatggggcgtgggcacccacctcctcttgcgccttgagactctcctgctcgttggcaattcagtgttctcgctgcaagcggctgctacgcaagggcgctgctgcggtcagtggctggactgtgactgcggacggcggtgactgcgttggccccctacccatcccaggtgctcaatttatagtccaggaaaggtgtcgccggcgctcagggccacccctggtgtctcctcctcccgcctcccccggcagcaccgagataaaaggcccaggccgggatgaccgcgagtaacactcgcccggccctttctacagcgggggcggggcgcgccgggccagctccgcctctcgcctgatacccgggctgagggagggcgccggggcaggccagggcagggcagggcagagcagaggaggagggattggagcagctggaccccgccagcaccaagccctgggcaggccagatgaggagggccgggcacagcgagggtcaaaaaggcgtcggcgtccggaccgactggagggtggggctggcatgtgggggctgggcgggccttgcgcgcgctccccgcgtgggatgaccagaatgcacgtgccttggttgcagagtgagcccctcagccccgaatctggagtggccgcggccgggaaacaggaacccgggtttattattagccgtcggggaagaggggccggcagcaggtacaactccatcctgggactcttacgtaataaagggtgaccgggcatgctgggtgcacgtggacgcgcggtgctcccgcagtggccctggccttggtcagctatggggggaggggagcgtcagaggcttttgcctccctcctggcggggtgggatctttcccaatctttcctttaacagtggttgccggggatgaagaggggcacactatcagatctgctgattctttgaagagatctgcaagtggcaatggggagaagtccatttttgtccaagtcggctacacagtgatgctggagagcctgggccatgtggccttttggctgccaagaggccaggagagggtgacagtagttaggtctagtcttgggtgtctttcaccatttaacagagaaatggggaggtgtctaattatttttgagggtgcttgtgtgaagtgttcctttcaaaagatagttcttaaagcactgggtcatttaatagggcctaagctatgtaccgaatcgctggatttaacttttaagagccttgcaccttgaatttcactttgagacttccaaaccacagcctatttaatttttcccatctcatgtcccttgccatattcctcatccaccagtcctctctggcagtcctacaattatgttcaataagattcaagcttctcattttaaatcccttttctcggcctgaaacggtggctcacgcctgtaatcccagcactttgggaggccgaggcgggcggatcacaaagtcaggggttccagactagcctggccaacatggtgaaacccggtctctactaaaaatacaaaaattagccgggcgtggtggccagcgcctgtaatcccagctactcgggaggatgaagcaggagaattgcttgaacccaggaggcggagttgcagtgagccgagatcgtgccactgcactccagcctgggcgacagagcaagactctgtctcaaataaaaaaaaaaaagatcccttttctctaaaacttaacagaggtctctgtccctagtacagttttttcccacgggacaaaaaatgcctaaggaagggagaacataataaaggggtttctttctctccctctttctttcacattaagacctacacttaaatattttccatagaaaaccatcttcctaattgtcttttgaatgaaattctgacttggtgccacaaggactaatctgttgacaaaaaacaaacaaaacaaaacaaagtcagtgacccttggagacagacctaagtctgaggacccactaccccaaaacgtattagctctacatcacagcccatgttttcttacttgcaaaactgggatagacctatcagggttttgaaggaagatcaatggaaagaaaaatacagggaggcaggaagcattatataactttgaagcattaaaataatttcaccttccttctctgcacacatagaaacttttctagcctcagtttctttatcaaaaaaatggagcttgttccatgggccgtgccaaggactttgattaagtttaaatatgataatgtaaataaaaatcactatgtaaattgtaaagtacaaagattaattgtacttgatacaggacctcatcatagtgagaggtgtttatgtgaagagtcagaaaccttaaaagtgtggaaattgcctatgatgagccacagatccttccacccaacccccagtgcttaagcaggaaaataatataaaatatgtccaatgagattgaaagagcactgcaagaagaaaactcgagaaaaacagatatacagtttctagtagctgatcttctcataaattaaagcgtactttgtcccccttcctggacccatttggtattttaagtacgtatgcacccggatgaaaactcggtattcagacttaacttactaaatgccaaaatcttgcctctttttctcttcttcccagttccaacagtgtgataacacacggaaaacggaaatccaagggatctagcaaaaggattccacccagcaaaaacgccagcttgggagagggcccctacctaactccttccttctggcctccacccctcccctgatacgtttccttccgtctagtctcgagataacccttcatcccccagtttcttgactctggccgctgttcttgaacatttcttaaacactttcagagaaagatggctcatgcacctgcctgcaaaacttcccaaaccgggcctcccagctcccccagaccccgcaacaactcacacccgccggggaaactccagaaggaaaaggtccgccggccagagctctgggcccttggaatcaccccaccaccgcccctctggcttcagccaatcagaagccgtcagaaaatattatgcaaatgaatcctgatgctccagccagtcagaagccgcggagccctcccccacgcagcgtcctctttcaccccagccccgccaagctggctgccgcgtccctggcaaccggcgcgcagccagttctccactacgcttggctgtaaaaaaattaaaatggttgcctggggtcacatgggaggggagcgggctggcccaggcctaaggaaggttggaaacctcactgattgccccaggcaccttccctgtcccgatctggaacaggctggaggtgctgagccacctgcccggaattcagtttgcctccagaaaacagaagtcatccgttgaacaaataactttcgagtccttgtagcacgccaacagcctcaaagcaagaggtctttggtctctgctttctatcctatatgctaaatttccggtaaaagccttgtctgaggtacccatccccacttcttggttcacagttgcaattctggaattctggatctctttttttttgttttgtttttttttgagacggagtctcgcactgtcgccaggctggagtgcagtggagcaatctcggctcacttcaacctctgcctcccgggttcaagtgattctcctgcctcagcctctccagtagcttggactacaggcgcgcaccaccacgcccagctaatttttatatttttagtagagacggggtttcaccatgttggccaggatggtctcgatctcttgacctcttgatccgcccgcctcggcctcccaaagtgctgggattacaggcgtaagccaccagcgccctgccggaactcttaaattctggttcttaattcccactcttttaattaagcaacctggaaagcatgctttgctggctcatctccccaaaaatgtccacaaattatccttgtactgtgtcccttggatagtttttttttggggggggggaatgacattttaaaagtgaccagaaattcctgaacaaagtagtcagcaagagtaaactggtgcaagaaagtcagactggataaagaagagatctggcctagaactggaagaaagatgatattttaaggcaagaagccagcccaacccaagatagcagagatcctggattattttgagacagacttagaaggatccatttcatgaaaaatgtcctagaaatatgacagtcagactctcgtgttaaaggccatgtagtccaaccatccacttgtgctgaaatcgctcacaacatccccaccaagtggtcgcccttgcctacattcttctattttccgttctccagtgttcttctatcttttggagctctacagaaggccatgaagcacaccatcagatgtttgaaggtagatatggtctccttaagtctactgttcttcaagtcagttatccccagttcctgtagccattcttcatgttctcttttgagtcgctcatccatcctagtcactaactttagaagtagctctggtttgcttttgagtgtggcccctctcattccaagtaccatcttttctaggacaaaatggagtggcacagccacttatattattgtgaatggtaatttttctaggtcatatttattgagcacaagtgcttggaaattagacttgttaactcaaaagacatgttaactcattttaacttcacaaccaccctgagaagaaagcaaggatcaaagagtttaagggccaaactgtcagaactgggatttgacccagttttctaatgccaaatccaatgttctttctactactcaatagatagctactgcttataatgctgcctaacatttaatggacttattttaacagctacatctatatgctgccatctatataacaaaattttgtgtaccctatacttgagtagtggggattttttggaccaaagtacagaactttatattatcctacttaaactttatctcattggatttggcccattagttcagcctgttttattattttgggtcctgattctgtgctgtaatgcacttggatcttacccatatatttgataactattctatatatttatccaagttattgataataggtaccaggcaccactgggcaagaggcaaattgctgtagaacatctggagagctccttcagtttgatatccgtccattaattggcactttttggcataagttgttccagccagctatgaatcatgttaattgtacagtcatccagcctatatttttcttcttgaccacaggatattatgagagaccttgctaagtgccttgctgaagtcccaagctaatagccagttttcttcctgtggagtcaagaagaagggcatttttgtcatataccacaaagaaaccaccatcacatgatacaaaaatgcagaaatagcatcataataatctgagttaagatggggaagggagtgtatcttattgtaattgtccttacaggaaaaaccgtcatgaaggtttagttgagagaaggtagacagaaaaatgccaaaacctaagaacagtgagtagtgaatctgctggcttcagatccactttcaggttttggaatgtctgaatatgtcgtagttagcattttgtcacaatctcattttttaaagcgtctttagccttgcgtttggaagaagtagagcacagggaaagttgagaatactaaagaataccttttgttatgttctcatcatttctacatctttaagaactctgaaccgtatacagaactgtacattcaatttcaatatggtagatgagaaaagggcaagacacatcatagcttttcttaccacatagaaacttctcaagttgatttttcctagatccttaggattccaggactttcttgtaccatcagcatagaaggaagaatgagaatgttctttcttcactctatcctgttaaaatgtgtcagcttggttagtttaaattctgaaattagattcaaagtttacaaattataacaccaaattagggagaaaacacataattatcaatatttcatatgttcaagtcctaattacaaatccacatatatacatatacatatgggttgtagcttcattttgttgaagctacagtgtcataaatacattatccaatggacgggttcaacagttacacgcccaagtcttccataatttactcttccaaccttaataataaaaaaactagacctagacaaggtacaatgaagtcaaggcgaattcacctacatcatattagacagtctggacagagttagtacacaaaagatgtaaatctagaagcaaatacaacctacaagtccttccagctatagaagaccttgataagaatagaaaaataataaacaattaggaagatttgaaaaaggatattgcagagcaaaagaaacaaaatttgaaccaaacacatcactagagagtcaataaatgtaattccaaacaaggaacaaaacaggcatgccagaaaattcagttactggcatagggcaaaaggttcaggtaatcccaatgaaaagacacaaaagagtgaaagaaaatggagaggaaatgttggatagagaagacaaagacaacataatataggccaggcgcagtggctcacacctgtaatcccagcactttgggaggctgaggtgggtagatcacttgaggtcaggagtttgagaccagcctggccaacatagtgaaaccccatctctactaaaaatacaaaaaaatttagctgggcatggttgtgcatgcctgtaatcccagctacttgggaggctgaggcaggagaatcacttgaacccagggggcggaagttgcagtgagccgagatcatgccactgcactccagcctgggcaacagagtgagaccccgtctcaaaacacacacacacatacacacacacacacacacacacacacacacacacacacacacaatataagcttaactgatgtttccaaagagacctcaacatgtgaaatagaagaaattcagttgtaacatagaaaattttccttgacaagatgcattcatctgcagatttaataagcatactatataccagataaaattatgcagaacagttgaaaaacaagctagttgtatttttcaacttcaaagaagaagaaaaaaagccttcaagtgtccaagcaggaaaagaagtcaccaaaaagatggtggtctcaggggaggagagaatccaaccagctttacaaaaacattccactacaggagacagtggagctggaagaaagaatgtatgattcaaaagtattatattactcaagcaaaaaacaataagcagacattctcaaacatgaactcaggatttttcttgagaaacttactggtagaagcctgccaacaacaaaaaaaattaatttaaatgagtaatccaggaatggagaaaccctgatgaagagattcatagtgagtttgaatcaatttaaatgcagaagtaaggtaaaacagtgtggatactggttgcagaatataacgtaaatattttaaaccctgaagatgaaaaaataatgcaagcaacaaaactggaagatgggggaatgaaaaatagcagagctaaccaactttcattgcagcaggtcaatcaatgatgcctaaaaccaaattgtgccatttaaaaactaaagacacaaacatcttaaaactttacaaaatattttttctcaatttaaagagatcttttaggaactaatacattccatagcaaagagtctgttttctaaagttcagtatttctttcagtgtaatttcaagtaaaattaattttaacatttcatttaaagtagtaggtatgataatgttctttttcttcatctgggtgcaaggcgctagttacacaggtgtgctcatcttgtgaaaaattgttgagctgacacttatgtttgaacttttttgcatatatcttatacttaaataaattttttgaaattccattcacataaaattctagggggtgtgaagagagggggtgagagagtcaacagtctgaggcagtgacctggtttggaattaaatgctctcagtaatttttgcataaaaacgtttgtgaacccaacttaaatgggaataggaaagtagtaagctctccaaattttggacccttggggcagaaaccattgtttttgctctctgctcctgtcaactgcagtttaagaaatccagtgttgggagcttccaagctttagtcttggagaggaaattctattaaaacaatgtttttctgtaacccccctaaatattgtttctaaaagtatatttgcatagcacatatatagatggctattcacctttgttattatgatctatagctgatgattcaaaatatctggaaaacttatatctactctactttctacgaagtctgtagtagctctttactaaaggtagaaaaaatcatgttagtggagttgtaggagtctccctgtgccctcatctataccctaagtctggtcagaggtatacttgcttatctatagtgtatattcttttaaccacactactgtacaaagattagctttaacaatttggcctgcaaagattggactttagatcagcattaatcctgggcagtccaaaattcaaatggggcacatgattaatttccttgtttcctaaatggtttcacaattaatagaaatttggaaataaatttatgggtgtgccattaatagacaccttgaactttattataactatcattttctttctagaaaatatattaaacaaggaaacatatattttccatctctaaggcacagggtgtcttgtataattttattttgcgcaaagtgggtgattaccttggccggaagtataaggtgcttgtttgtggcatagggttcagtcagtaatatttgtcataaatgtttatttgaggctacatggtgtctatcaaaatgacctcattagtttctatagaagagactcaaatatctttccaatcttgatctaaactattagtaaatgtaaatacgaatgctgaggtgattcacatagtaattagatcttgggttttagaaagaacaaccatgatttacttaacaaaaagtctattcctgcagatcatatgaagcagaaaaagaaagtctgataagtaaaagagaaaaagagcagcatagccaggtattaaaacacatcactctcatttagtctccccaactagaaggagattatctaaatcattggaggaagaatccagaatattccaaattgatgattcttgggagtttatgaaatattaaattaaaaaattaaattagtttcagacagcacattcagctttgttatatccaggttgaagcaaattagatgccattaaaaatggtcagttcagctgcttttataaatgttgttcttgcctgttatatccaggttgaagcaaattggatgccattaaaaatggtcagttcagctgcttttataaatgttgttttttacctactgtagggaccataattttaatgtgttcaaacaattggttcaagtgcttcacacttctgtgtaccatttgtgtaatttctccatgacagaaaaacagaaggcttgggtttttaatatctaatgtcacgttcattcaaaattctattttttatttattcaagcacgatgtatttatttgccttccttctagaatatgaccttcaatctaccttcctgaaacagttttccttgcttctcccctctctttccccatcaaaaaggccaaaagttgaaatgggaggaatgggaagataatgcactcccaagcccctaattattttggaatgctctgtaatctactcaaaaaagcaagatgtacaaggaggtcaagttcacctacaagatactgtctaaggcaatataataaattaacaaaaaaattaataaacggacccaccaaagtaagtgactaattctagaattatgactgcattcatataaaggccataaaacatctgagtagatttgtgttaaaatatcaaaattaggtagaagtaaatcatctctaacagacattctacttatttgagaggatggggtggcagcccacgtagtgtaattaaaaaagcaaaatgtctggagtcagacccatcccccatacccttcacccccatgtaaattacctctcttccacttcctaacttgtgagctcagagaagacatgtactctgcaagcctcagtgtcttcaccttgcagagtttatggaaaaattgaagatgaggtgtgcttcttgtagaatatcaggtgcatggtaagcagtaaatattaatatgttgcctggctgggataagtttttaatgtatattgtattaatatgcatcatgatgctgtttatgagaactgtgattgaaaataaatatctatatatttttgcagctcatctatcttttgtagtgtggaatcatgattgggaccttgaatcttttctactttcacttttccacttggggatacatgaggtacagcctgccttccttcctttgtctgtctttccttccttcctccctccctccctcccttccttccttctttccttccttcctttcttcttttctttctttctttcttcctctctccctcccttccttcctgcctgcctgccttgcttcctttgtctttctttcttcctttcttcctttccctttctttatgaggccctcactgtagcctcttggaaactttatatgtcagcac

SEQ ID NO: 872 - DNA, 11819 bp, mus musculus; identical to SEQ ID NO: 871

SEQ ID NO: 873 - DNA, 5708 bp, mus musculus
atggtaaaatagtaaaatttcatttcttaaagctggattaatttggtatgcaaataaagtgtaatgaattattaaatcactatcttgcatgcacataaaatgggttaaagttatccaaatttcaattgtgcttctctttttttgtcagttgaatatatacgattagcactgcttacttagcttttaaatatgtgtgagatccattgtaaacaaagattatcttcacagtggtgatggagttacatttaccctagttgatctacaaccatccatggcctagtttttaaggtaagaacttcattctaaacaaagtacaccaccccatatcccccagactctccagtctgtatcagttactacttataattccttcagtctgccttactatttgccaacaaagtgaccttgccttcaagcttcaaaatagcctcctcaatatctagcattagttcattttctttcatttggaacaggtaagagtgctttgagaatcattatttgcagggactcaactttgctctattagaaaatttttattagtaaatttcttatacttagctcataggaaatatgtctgaaacccaagtttgcaatttatcatgtatgttaggataaatatttgaaagtttacaattgtcattacatttttagagtaacaaccataagaggctcagaacacacaactgtgtttgaagtggttagtttcataaccccaagatgcaaactggaccctccacttgcacccagactcattaacagatccaagagcagcctgaatttacagtggaaagtaaggattttactatcaaaagcacctgatcatgtttttataatttaaaaatactcttcctacagtgtcctaaattgtatagaatgatgcatgcctcatccgacttatttccctagcactttgtattattcataataatctttcccttctatataccaagcatcaaggaaaattgagaaatgtttgtaagaatttcaataattaataaaagttggagtatcgatttctacaacttaattatttatcattgtagttaccaataaatttacctctcaatttgcttaagttccaatttttttcattgtatacaatttggaaaacataacaacacatagaatctaaggatgtcttgtagagtgtaaaaagtgcgttttagctttaaaatctggattgcttcataaaatataagcagattaattttagagtaacatatagctttaaatttatatacatatgcatacatgtatttagcatatatatatgtattccatgtaaaaacagcccctcatgactttttaaaaacatttttagggtttcaatgataatcgttccaaaataaacagcttccttttggaatgggatgaagtatacagttttatttttaaaaagcacttgtttgtggatgattattaatgttatgatgaatttttgttgttaactgtagcattttatgatattctagtattttgtgtctattattaaaggcaaaggtgaagacttcaaaagttgctatatgagtaccatgaaacagcacaagataattgaactgagtatttctacaaaatactcattcagattagctaccagaaacaactttggcttgaagtatatttaaatatttacaatatttaagtctatacttcaataagaatctgagactaattttccatcttaatctattcttcagtgatttcagttaaatagcagtcttccatacatcaggaactatgcctgcaacacctccacctcctaagctaaaagaagcaggaaaggaatctgttgtcagtagactggtgtgccccaacacaaacccaaatgacactcctacttatgtactagaaatggaggaagcaggatctgtaagcttttctttcatatgctttaatcttcaacctcagttttaggtatatgttatatggattccgcacttgagaagatttttaatttaatcaatttgctttctactcaatcgattcattcaggaattgcatgattcccaagtccctgtgttctgcagggagccaatgcagagccaaggttgggccaggaattgcgtgattcccgacttcctgtgttcctgatggggccaatgcggagctggggttaggcaattctgcacagaaagatctaaaagtactcaagtctctgcaaattagctagaagcagcagcagccataacaatagcatagagactcagagaagcgtgttagtttttaactttgggcctataccagacaatcttgcatagtcacataaatcttcagcacctcaacatatttctaccctttgttcatataactggattcctgataagggtgggcaactatttcattccatcctgaactttcaagtctgtactgaataggctggtaaatttgtaaagcagctgtaaattacattatgtatattttaccacagtttacataaagtagataaatgttgagaagtgttctatgttgcaagtaacgtgctaagtgctttcacattcattatctcattaaatccccccaaaggaatgaggccgtcaaagtagaaattatctccattttttatatagagaaactgaagttcagagagactaagggacttgctcagaatcacccagatggaaaataagttgaagttgtaatgcaggcttgcccagttccaaagttcattgtatttctagggtttagattttaagccgaaatacaatggagaagacctttcatgcactacaagaagtcttcagagaagtactacatacaagggtatgtggctatactttataaatttgtgtcatattttaatataaaattatacttttcaccagagaaatgagtatattttgtttgaaatcaaaccttattttgcatttagttcttagaaatgctcactcaacttactttatatttgcaaactgaacattttcaaatcagacgtttatttgcaatggtcaaccatatcatcctcttttatttaaacagatctttgcctgcaatatggaaggaagaagcaacagcagtggagaagtaaaatatacaacctgtccagataaaaccggatcccctagaaaaccatatataaagggaaaggtccatgcacacagtgtaaaaattggatggagtaagtaatgtttttgtatttaaaattttccctctgtcttaatattaactattgagaagaaatcttcctctcattgtcctcagctttataaaatgttcttttagtcatttatatgtgagatattctgccatataaatgagtttagttgtaaactatattatttttctagttctctcttgctatctcattaatttgcaaatgaacacattattgagctttatgtgtccttaaataagattacatctaatatggaggccacaattagaaggccacatcaatgataaatgtcagcttaagaaattatattcatacaaattattttctctctaaactagagaaatcaactttatggcacatatacttagcttttcaatctcttgcaaataactttacaatatttatttaaatgcttcatttctaatattccaaacatgtaactcgaattatgtttttattatctttattaatatgtggttattaatacactattgtttcatgtttatattttttcctctgtgaaaaatgtttcttaactcatgagataacattccagtgggagacttttaagtttattcaagaataattttgattttatttctcttttcagaaccatccaaagataatggtggaacatacatttcaagttacagtttagaagttagtgaaaattcagatggtaaggcatcatgatttttaaaaatattttattttgaaacaattttagactcactagaagttgtaaaaaaaaaaaggtatagagagttcccatgtaaaatcttcactcagcttctcctaagattaatattttacataaccatagtacaatgatcaaaactaggaaattggcattgagataatactatcacctaaacccgagaaattacttgaatttctgcagtttttagtaataaatcatgtttactgactgatatcttacgattttatggttaattcacggggcatatattattttactattgaaatagataactggaccaacttcatttccaaaattgttattcttagtatatacatgagatatcatggaaaccggtaacatttataagcaagctgggcacagcggctcacgcctgtaatcccaacactttgggagaccaaggcgggtggattacttgaggtcaggagttcaagaccagcctagccaacatggtgaaaccccgtatctactaaaaatacaaaaattagccaggcttggtggcgcaggcttgtaatcccagttacttgggaggctgaggcatgagaatcgcttgaacccaggaggcagaggttgcagtgagccaagattacaccactacactccagcctggacgatagagcaagactccgctcaaaaaaaaatttttttaaataagctacctataaataaattgaataaatttgcttttatcccttcagtgaatctctgaaacataatttacagtggcaacaaaggaatttctacataatcacctgcaacatgatactgcatataaactgagagtcttttatacctcacttataggccagacaggtgagaaaagaaggatggaaaacattttaaattgaagactgaaatgagctgtatcatattactaaatgttttacaaaactgaacttgaatcagtacagtcataaggtattttttctttctcttagccttcagatatattgactattcaaacacctactctttctcctgcatcttgctgtcctccacccttgaatggtaagacaaagtccagagaaaccaatctcctatgcagtgaggcttctttgtgtgatttgtatgactaagcctacatttcctgttttgtaacttttggttttttatatattaaatgatactaaagcagaaccagtgattttcttttagaatataatcaaatattggtcagccaattgtttcattttttactttgttcattttttagactccgggtctcactctgtcacccgagctggagtgcactgacagtaatcatagctcattgcagccttgaacccctgggctcaagcaaacctccctcttcagcctcctgagtagctgggactacaggcatccactgtcatatccagctacattttttattttttgtagaaacagggtctcactttgttgcccaggctggtcatgaattcctggcctcaagtgatcctcccacctcatcctcccaaagcactgagattacaggcaggagccaccgagcctggccagttgtttcttacttagtaattgaaaccacaaatttttttgaagtctgtaaataaaatttaaaaattaattgacacaaattactacattttgagtcttctgttactttgttttaacagtcttctcaaattattttgtataattctagagaagcacctttaaaactatttacaaaatactttaagtttgattttgtatatttttatagacaattatcttgctaatggaaaccctgaagaacttgtatatgtcaaaaaagcaaacggtaaccaagatgacacacaagggcaccctggctctgacgtgaaatacagattgagtaaattaattcccgtagaatccacagtttctagttaaaaacagcaaatagggatagagaag

SEQ ID NO: 874 - DNA, 3236 bp, mus musculus
gaaggcaatccggccctttccggtggaggacccttccccctgggttgatcttgaggaacttaagagacggtgttttgactcgactcctttcccctttttcctcccggtaccaaagcggttttgtttgctgtttatactctaccccgtggaaaggcggctagctggctaaagggttttatgcctgggggaggatgagtcgctatttggtcgtgacttgtttctgtttaaaattattattatttaccaaatgaaaatgttgtacttaccagtccaaagtgcggggcttatattgttagaagaccacttaaaatgctcctggattctgacaaatattgcatgagaaatttgcaatcagccgtgaagcatgtttccccttctgaaagtttaacacgtgccgtatctacggctgggatctaacacatcccattcctacagggtaatttcctattgtgttttcaaatactactaaagtactttaaccaagagttttcaataatctttatgtattattgcctatctctatgcaaggtatcaatagttttctacaggttcgggactacactgtttaatatataaccccaacccttggtaccgcactgaccttcagtatttggttgctgaaatcttcaatgatgaaaggggttggtatgataattgacacagattagtaaaccgggtccttttcttccctactttcccgtaacatcctgtccccaccccactccctcacctaaacctgatgagaccagaaatgcattttaagttgcatgtattatttacattgaaatattacaatttgaaggttcatctaaatttaaggctatattcttgggaattgggtttcctcactcagctctgccactgaccacagtgggccttgaatttctaagttgacataaacttagcctaggttgattagctctcacttgtaatttttttttttcctcagaaagcaataaccacaggaggtaattgtgaagtgataggcttatctttggttgttattgccatggaacttgacaaaacaaatatgaataattgatacaacaaaatgatataaaaagatacatgagacctagacaactcattgcaagtagtttagcaaaataccagactgaataattttatagttgaagtataatgtacaggttgagtattctttatccaaagtgcttgggaccagaaatgttttggattttggactttttcagattttggaatatttgcatatacataatgagatatttcagctataggacccaagtctaaatttgaatttcatttgttccatttataccttatacacatagactgaagataattttatataatattttcaataactttgtgcacgaaacaaagtcttgactgccttttgactgtgatcctccacttgaggtcagatgtggaattttccatttgtggcatcatgttgacactcaaaaattttggattttggagcattttgaattttggatttttagattagggatgtttgacctgtatgtaacagttaacacttaacaagccattatcatgtcctcagcacttttacgtgcttacctcatttaatctttacaatgaccctaggagataggttcaattgttattctcattttacaaatgataaaaatgactatgaatttggtccactcacagcctgtgaacctcattcctcacctgtaaaatgtgaataataaatagtatttgccatgtctacttcaaggaattgttataaaattcgtgtgaaaatgtatttgtgtactctttcaaaatttatgtggcagttattccatgatcacctctgtatcagtcagttcaattattaatgataacaggaaattggaataatgagggcttagctagcaagaagtaaagagaactctaaatactacagatgtagcaggtatataatagtagatatgatagccactacccctggaactgagataaagcattctcttcccttagctgagatccagaccttcttagagagaacacagccagtggagagtcactctatggcaggaaatattctgtattgccttacaggcagaacttgctgaaactccaacctctggaaattactggaaccctgcattctagaacttgctggaaacccaccctctggaattggcctgctagagtgcctgagaaggatgttcatagggaaatgtttcagcagaggaactctactacaaaaaccacaagagggagggtgccaggggaagtggcctggtgctattgaaactgcaacacagaagccagccactggagagagctgcacaagctgcaggaacaccctacccagtaagccggccagaaggagggagcaaaaccttttctctctgcaacatctttccagtttcctctactggaaaagcttcattgccagctgacaaaaggaaaaatacttaaatggatcagatccattttcacagagcagtcaataatggtgaatttggagatgataagcaacaaattgatgaactggcacaacttccctgctactttcttgattgtaatgcctagatagggaataggaaagttattgaaatgtatgtgttcccatgaaatgtgtttatttgttgttcaagatcaatactaataaatggggactaatgttctgaagtattttggaacaattagaatcaccactcttaaccctgtggccaaagtcttaaatggacagggaggaaaatgtttataaactgaagcaaaaattgatctacatagaaaataaatctggagtatttacttggtaggtatactagtttcctagggctgccataacaagttattacaaactgggtggcttaaaacaacagaaatttgttctctcacagttctaaaggccagaaatccaaaatcaaggtgtttgccaaagccatgctctaggggagaatcctttgcttcttccagcttctggtggctcctggcattacttggtttgtgagagcataattctaatgtccgcttctaccttcatatggccttctttcatatgacatgtcaaatcttcctctcctttttcttataaggacaccagtcattggatttcaggctcacccttaagccgggatgatctcatctccagaaccctaacttaattacatccacaaagaccctatttctaagtaagatcatattcacgagtactggggttaggacatggacatctttttggaggacacaattcaatccaccaacacatttttattttactttggtcttta

SEQ ID NO: 875 - DNA, 3236 bp, mus musculus; identical to SEQ ID NO: 874

SEQ ID NO: 876 - DNA, 22680 bp, mus musculus
gcacttggacttggccggcgctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccacttggcacttcttttatttatggttgtcacataaagcatctaaccatggtttttctttgttttgctttcttttgtaataagctttccacacttggttgaaaggcatattgtcaattgcatttttttctcaaaacaactaactttggactaaatatattaaactattttaaaagccatttcttttgcagatattggtgaatgaactttgctaagtatggattcaggcggtggaagtcttggattgcacacgccagactctagaatggcccataccatgattatgcaagattttggtaaagcattttctttgttgtatttttttcttttttagaagtaaggggataataaaaatcaaaaataagttgaggaaggggagaattacaatgaaaacttgttcttttactaggaaaatatatttgtagagcttattctcataaagctgtgtgtcagtggtctacttaacatcacttttacaatttaggggaaggttgtgttagggacacttgaaatatggtggtaatatgttactggaaatgaaaaactcaatttacataaataactgcataattatatcacattctgttctgatagtatatatcagctctcacgtgtaggaaatgttaaactgactttctaaaacacattttaagttgcattgttaataaaattggaaaaagaagtgcttacatcaactaaaaaaaagatgcttatatagtgatatgcagaatcatgcactaggtgattattattgtgatgctatttcctcagaaagttgttaccattagaatacatttttctttctcttttttttttttaaaaaaaaaaaagaggccgggcttcgtggctcatgcctgtaatcccagcactttgggaggcaaaggcgggcggatcacgaggtcaagagattgaaatcattctggccagcatggtgaaaccccgtctctactaaaagtacaaaagattagctgagcgtggtggagcacgcctgtagtcccagctactcaggaggctgaggcaggagaattgcttgagcccatgaggcggaggttgcaacgagctgagctgagatggtgccactgcactccagcctggtgacagaatgagactcagtctcaaaaaaaaaaaaaaaaaaaaaaaaagactccttactcttgtggccaggtttgtaagtagcctcttgacagtagtcattttgatgaggatgccaagactccattgacattcaacaaataaactgaatttggccagggatgatctgaattacagaggagatagagctatttgaagtataaaaggcagggatgagatcaaaagaattgaagataagattggagtgaaagcagaaaagacaaatggtgaactgcgataaaagaacagggaacgaggtaatatggaattgttgaagctgaaattagtgatgagggaatagaactgtgatactttgctaagttaagaaaatgctactattgttcgttgataatatggttgaatgtatcatttggtcccctgtagtaaatcccacagtaacggaagtcagtaaagccgtattctagtcatggcagtgctgttaactagctgtgtaaacttggataaattactgaattcccttttataatgattgcactagataacatttaaggtcctctccagttatagaattctttgacgtttctttctgatgaataaagttgagtagtacaatattggatgtgagttaattgatgaaatataaagaaatcgtggatgtattcttctgaaagctaagtgaattgtgttgactatggatgatttagaaatgactttgggtgaaaaaaactcatcaataaattctagaggaaggataatagggccaaagagtaagagattaaagatattcccatgaattctttagtagagagttgatagtttttagaataatggaacactggaatttcagtatggtaaataaattttggttgaaatgtcaactttaattttttaccttttaaaataagatatttttaaaatggaagtattatagtagtttctccatttaatacaaaatattacctctcctatagcatttgataaagtgccaaaactcacttcattcctgaagaggttggctattagctagtaaagtgtgattcctttcaaaagatgaaaaaaaaatctgattggtgctggtgaatatttacataatgttccttttaaccttcctttccattgtttatcctcaatgtctttagaattaattactcctttattacatctactactttttttcttttagttgttaggggaatagaatatgcatattgaaatatttaacatatatgttttttcttctttactttttattcagatacattcacataccattccattcatccatttttataaagtatacaattcaatggtttttagcatattcacaaaattgtataaccatcactagtacctagttttagaacattttcatatcctaaaaaaagacacctcatacccattagcagtcattccccattctgcctctccccaccagccctaggcagccactaatctttgtctgtggatttaattattctgaacattttatataagtggaatcatatatggtcgttgtgtctggcttctttcacttagcatgtttttaagtgtcatccatgttatagcatgtatcagtacatacttcattcgttttcactgccaatgatattccattgtatgagtacaccacatttggtttatttgtttatcagttgatagatatttgggttgttgaaatatttttaatccactagaaatattatgtgtttgacaaaataagctttgcatcttagattgaagtatgagtgcctttggaggcgtgtgacagtatgccaaggcatacctgaaaccacagaataaatagcagagcctcttggaatttttttttcatttgaattgaggagaatatatatacacacatatacctatacacaattatagctgcataaatatgtagaaagtaagattttcgttcactatcccctccctttttagaaataataaaattgaaaggtttgtgaactacttctaatttttaattagtattttcatattatcatttaaagccctctctaaaatgaatttaattgagtaaactgatttgtatcagaaaaatgtttaaaggcacttattgttgtttttgttgttatatacctgtttatgatttaactggtagtattttgagttagtggttttttcaaatgatgcattctttttaaatttcatttttatgctctcttaaatcaaggtatataaatcaatggcagttaaattacttttgcatttttggtgagactgtttttctgaatttgctattagatcaagagtaactaatatgggtaatgctcactcatttgtgcctagggataatgttgacttgaaatatgttaagtttccatttgtccttggtaaattctgaactcgtaaaaggcagtaactcactctatttttgatatgcagttcccagcacaatttcatttataggcattttcatttttgtatgatattttgtgaaatgcaaaggttgtcaaacagacctaaacctaaaaagacctttattaggggacttctggaaattttagccctgataacttagatttcttctgaaagcagcccccccatgcttattttacctccctgttaaaatttctaaattctaaaatttcattagaaattagatacattctctttaaattctgttagcgtcaaaacttagatatttgcagccccataaattattgacatttgtgaaacttagagtttaacatacacagagctaaccaaataagaacactgtggcacaagatctccaaattctgtaaggttcttggttgatacaatacagaaaatctgaaacattaatttaatgcataattcattggaccaatttattttgaagaatatttgagacttagaaatttacaactttgttcaataaccttgctggtgtctcagtataatagctgtccttgaagtatgagattgaatttaatagttgtttaagattttaatgctacaaaaagtctgtgttgttttaggatataaatagcaaaacacccttagatagtggcccaagacagacctgacacgtaacagattttatgctgtcattctggtgatgttccaagtattcatatttaaatggaataactttaataaaatgggaaatactggaaatcaggacatgtttcttactgttgcctgattatttaattttatactttttaaatgattttttcttattgtttataattttctaagctagtaagatgaattattaacgcaatttaatgctgtttacgaaatgatttaaaatttaaatgagctaccacgtgataggccattttactgtttatctcaagctgttcctctagctgtgcctcacttagttaatcttacacctctctttaaaaaacagtatctagggtaaatatactctaacctcttcccaggcaagtagaaaaaaggcagtctggagtcaaacagtgagttcagtttccagctaggaccttgtggcaaccttatataacatctgtaaaccatagttcctccttatttaaaatgaggataatcgcactcaccttatacagttgttctgaggattaaatgagatgatacttgtattagcaggttgcttgttggatagtcagtgcttaataaatatagctaatctatagctaagtgactttgtttagaaagtcagtggaatctaacagatgaactggtaagaagaacaagcaaaatttaataagagatatcttggatcttggtctaagtaatctgctgctaccctgtgagggacttaccaattcttggtctaggatccttgagagcatttggttcaggataaacaaacatatttggatttatttatttagttttttagatctgatctattttgacttgtaagttcctgctagaggctaagtgaactagcactgttccttcagtctatcctcttagaatccacccaaccaggttgatctgaaaccaagtccccactagcattattctacccttctttccttccctatggtctactttcaagaaccagactaatcttcagcagtgttctaaaataaatggaatttcccatattttaaatctttggtttgtgaaaagatttttgtgaattagtaattttattgtttagatatatagaattccagtacagttaattttacaggattaatattttaattttttccttgctaaaaaaccacatttctagtctgattaaatgctaaatttgaacccccacctcctccccatttctgaaatgcccagtggagtaacaactgaattaaaaatacttgttttatacatactcccttcgtgtaccagacttccaggattgtggctgtgtccttttggggtaatttagtggtttgggtgagagtttgagcggtgagaaggatttaaaagggttgaaagtaaagtatcccaaaaacgctgttgaaagctcagctttcccttttcaccttgttctttgatgtgttagtgtccattggtctccatcctaacttggtaactaacttccataatgaattgattaaaaataatgaacactatgtgacaaataacactctttcaggtactactttatagaaagtgatcaaaaggttttgtactggatgatttcttgtagataatttattataaccagatccacaagccctcttaatttgtttttgtaccacctcagggagcagaacttagcagaattcctcatgaagggattttacacttgtacaatatttacagggcaggtaggagttggtgtttaccatgccgctcaagaaaaacattaaagctttattcctacagatttactattatcaaaccaaatattagtctaagatgagtacagagtttttccccctaaatcaggtgttgaaagatgccttccaattttggatacagtaattattataagttaaagaagttcagacactttcatgttcatgatgtatattttataatagaatattttattaactcacttaacatattagtatccttttacgtttttgtgcctttttattttaattttttgaaacaattatagactcacaagcaatagagcaaaggagtacatacagtccatgtaccctttacttaccttcctgtgatggtggcatcttacataactgtagtataatacaaaaaccaggaaattgacattcacacattactgttaactagactacagacctaattcagttttcaccatttttaacatatattcgtgtgtgtgtatgtgaatgtatatattctatgcagttttatcccacatatagatttgtgtaaataccaccacaatgaagatgcagagctgttctatcactatatatatgctatccctgtgtgttcacagacacacacacacacacacacacacacacacacacacagacacccttggcaaccaataatctgttctccatctctatagttttattgttttgagataatataaattactccatttatacattatacagtatcataacctttggtgattgtctttttttccctcagcaaaattttctggaggaaattcaggttgttgaatatatcaacagtgtgttcatttttattgctgggtagtattccatagtagggatgtgccagagttggtggaaccaaccattcacctgctaaaggacacttgggttgtgtctaattttttgctactatgagtaatagctactatgagctgttaggaatatttctgtacagtgtttggtataaacatatattttcatttttctggggaaaaatgcccgagattgcaatggttggattgtatagtaagtgcatatttagttttgtaagaaatcgccaaactacgggtggatcacgaggtcaggagatcgagaccatcctggcgaacacggtgaaaccccatctctactaaaaatacaaaaaattaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaattagccgggcgcagtggcgggcgcctgtagtcccagctactcaggaggctgaggcagaagaatggcgtgaacccgggaggtggagtttgcagtgagccgagatcgcgccaccgcactccagcccgggcgatagagcgagactccgtctcaaaaaaaaaaaaaaaaaagaaaaagaaaaaaagaaatcgccaaactattttcgagagtggctgctactattttacgtttgcaccaataacgtttgagaaatccagtttctccacatcctcaccagcctatggtgctatcactgttttttgtgttaactgttttaattggaatgtagtgatatctcattatggcttttatgttttacttgaaaataaagtatattattttaaggtcttcatgtagattttactaacatcgttttcacccaactctaacccaattcctggttgttggtgattttaattgcagttaaattgtcaatgattttaaaaaatgatttatttggccaagattacttaatatttaagaaatatttatagcatttgatttattaaatacagtactctaaattaataaaataactttaccttttttggataattgtttgtattatagtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatcttgtaagtgaaacataaagcccataattactcaggagattgatttatataatctggaaaagttttctgggatgagggatatattcaataaaagttataggggaatctttttgaaaaataattttttgaagcagtgtcattaagatgctgttttgagtttactgatgtttttaatttattcaatgaaaattcatacctgaaatgaagtaaaataatgcagtttattagtatcttaaaatagaggtatagatttggcaacaacaagaacattaactgatacaaaattttaatgataaatatatatatttcaacatgggaactttcttatgtagccactgcttttttttaatatgacaggcactgaaattgtcaattaagtttttcttaggaacttaagcagaatatgttaagaaatgtattgatttttaaattaaatacttgaaaagtaaatcataaactcagataatgtcctacagttctccctgtgtttatattgcttatgcctaaatatgtgtgtgtatattttatgcaaagctatttaacatgtttattttagactgctttgcaagattcttaaaacattctatccgaagcgggaagatagaaatattttgttctcattttaaatgatgggtttatgagagcagcaacaaaaataaaaaatatcttgataagttattgatggagcttaaagaagtaggtatattagttattaaatttgaagggatcatgctacaagtagttaagattagacaattttttttgacttatccagggaagatttttattctttttaaaatacaaaaatggttgactgggaagtttatcaccaggtagagtgtgtgtgtgtatgtgtgtataaagtgatcgtatgtatatgtgtattagtgaatttaaaactgaaaataaactaaatttatttaatttgtgaatttaattgtaaagtttagcataacttttttcttctataagcacttttgaaggtgaatttttacattgtttttaagaaaataatgtaagccactaaaagactgcaaatattgttacctatttttaaatagatatagattactaaagcaactccatatttacatcttaacgtggcattttttaaaagatctatagtatggttatcatgtaaaatgatgtggcaaaagttggtagtctacactaaaattcagtatgtcttcaaaagagtattcattaatttaaactgatattaaagtagtgcaaaatttagatgtcatgtattgtgaacagtcataccttgtgttatcttctatgatttaattctgcaaaagttttttaaaaaagtttctggaatattctaagttagaataattattttgataactacctcatatatcaaatacaaggactcctttgaggaatataattttattttttgttgatttgtttggtttcaacttttattttaggatttgtacgggtatgaatgatcccatctcctaggtactgagcatagtacccaacagttagttttttggtcctcgccccactccctccctcccacctctagtaatccccaatgtctgttgttgccatctttatgtccatgaggaccccatgtttagacttctcttataagtgagaacatgcagtatttggttttctgttcttgcattaatttgcttagaataatgacccacagcagcatccatattactacaaaggacgtgatttcttcttttcttacggctgtgtagtattctgtggtgtatatgtaccacatttcctttatccagtccactgttgatgggcacctaggttgattccctgtctttgctattgtaaataatgctgtgatgaacacacaactgtgtgtgtcttcatggtagaatgattgttttccattggatgtatacccagagtgggactgctgagttgaatggtagttctgttttaaattctctgataaatttccaaactgctttccacagtggctgaactaatttacatcccaccaacagtgtttaagtgtccccttttctccacagcctcaccaacatctgttgtttttttgacattttagtaatggccattctggccataataaaaaaatagtagatgttggcatggatgcagtgaaaagggaacacttttacactgttggtgggaatgtaaactagtacaaccactatggaaaacagtgtggagatcccttaaggaactaaaactagatctactgtttgatccagcaatcccactactaggtatctacccagaggaaaataagtcattatacaaaaaagatactttcacatgcatgttcatagcagcacaatttgcaattgcaaaaaaatatggaaccagccggaatgcccatcaatcaacgagtggataaagaaaatgtggtacactatggaatactactcagccataaaaaggaatgaaataatggcattgcagcaacctagatggaattggagactgttattctaagtgaagtaactcaggaacagaaaaccaaatatatgttttctctcatatatgggagctaagctatgaggatgcaaagcataagaatgatacattagactttggggactcgggagaaagggttgtgggtggtgaaggatacaagagtaaacattgggtacagtgtacgctgctcaggttatgggtgcactaaaatctcataaatcaccgctaaagaacttattcatgtaaccaaacactacctattccccaaaaagctattgaaataaaaacattttaaaaaatagcttgtcagtatgaacaagcaaaataataataataataataataatgataatggtcattctcactggtgtgaggtgatgtctctgtggttttgatttgcatttctctgatgattagtgatgtggaacatttttttcctatgtttgttgaccacttgtatgttttcttttgagaagtgtctgttcatgccttttccccgtttttattggagttacttgttttctgcttgctgatttaagttctttgtagattctggatattatacctttgtccgatgcatagtttgtgaatatttttctcccattctgtaggttgtctgtttactccgttgatagtttcttttgctgtgcagaagctctttagtttaattagttctgacttgtcaatttttgcttttgttgcaattggttttggggacttagtcataaattctttcccgaggccaatgtccagaatagtgtttactaggttttcttctaggattcttatgtctagaggttttatctttaaactttggtccatcttggctaaattttgtatggtgaaacataggggtccagtttcattcttctggatatggcttcccagctatcccagcaccatttattgaatagggagtcctttcccattgcttacttctgttgattttgccaaagattagatggttgtagttatgtggctttgtttatgggttctcttttctgttcctttggtctatgtgtttgtttttgtactagtaacatgctgtttatgttactgtagccttgtagtgtagtttcaagttggataattgatgtctctggctttgttctttttgcttagggttattttggctatttctttcttggttccttatgaattttagtgtagttttttccaattctgtgaaaatgacgttagtagtttgataggaatagcattgaatctgtagattgctttgggcagtatgtccattttaatgatattgattcttccaatccttgagcatggaatgtttttccatttgtttgtgtcatctgtgatttcatttattagtgttttatagtactcctcgtagaggtttttcacctccttggttaaatatattcctgggtatttttttgaggctgttgtacatgtaattgcattcttgatttggctctcagcttggatgttgttggtgtgtagaaatgctactgatttttgtacattgattttgtatcctgaagccttaataaaattgtttatcagttctaatagcctttggcagagtccttagggttttctaagtatagaatcatatcatcagcaaagagagatagtttgacttattttactgtttggatgtcttttatttctttctcttgcctgattgctctggttaggatttccagtactatgctgaataggagtgatgagagtaggcatccttgtcttattccagttctcaagaagaatgcttccagtttttgctcattcagttcgatattggctttgggtttgtcataaatggctgttattattttgagatatgttcctttgatgcctagtttcttgagggtttttatcatgaagggctaatacattctgattttatcaaaagcttttcccatatctactgcaatgatcacatggtttttgcttgtaattctgtttatgtggtgaatcacatttattgatatgcatatgttgaaccaccctttcatccttggaatgaaacctagttgatcatggtgttttaactttttgatgtgctgttgaatttagtttactagtattttcttgaggattcttgcttaaggaacataattttgtataaagcaaaatatcttgttaacatcatgatgggagatctcattcaaacctccctaatttcaggggtaaaaaaagttaacacctttataattttaaaaactataatgacttttttgagatataatttacacatccttttatttacccatctgaagtgtgcaaataagtggtttttcatatattcacagggttgtacaaccatcaccacaatcaattttagaactttttcatcaccacaaaaagaaaccctataccctttagctgttagccccccccccatccactctgaggcaaccatgcctgtatagatttgcctatcctggatatttcatataaatggagttatacaatatgtggcattttatgtctggctttttttacttcacataatgttttcaagggtcattcatgtcatagcatatatcagtacatttgacccttgaacaatgcaggggttaagggtgctgaaccccgccccccctgctgacatacacacagttgaaaagccatatgtaactttcagcttaccaaaaacataactactaacagcctactgttgaccagaagtcttaccaataacagtcaattaacatgttttgtatgttatatgtatcatattctgtattcttacaataaagtaaactggaggaaagaaaatgttaaaatcataaggaaaataaaatatatttactattcattaagtggaagtgggtcatcataaaggtcctcatccttattgtcctcacattgagtaggctgaagaaggagaggaagaagggttggtcatgctgtctcagaggtagcagagcagaagaaaattcatggataagtggacctgcacaattcaaacctatgttattcaagggtcaactgtacttcattcagtattactaataacattccattatatgggtattatcacattttgtttatccattcatccatcagttaatggacatttaggttgtttccactttttggctattatgaataatgctccatgaacatttatgtacaagtttttatgtgagtgtatatttttagttttcttgggtatatacctgggagtggcataactctgaaatctaaaggtgactatcttgttgttcactttttcactctattgtgaaatacagattctttgtatattgcctaatcccatcactgtggtatatcagtatactgtatagtttttataccatactcaccatataattttggtagatgtaagtaacatgcaacaggtaaaataaaaagcctacctaacttttaaaaaggaatgttatattgtacatttgactaaaatgaaattttaattaaattgtgtgagtgggccataaaataatattgaatgttaccaaactttacagtgttggcaaacaatgcacttcactttcttatattatatttagtgccagaagaattctgtggtggttattttattacttattgctggattgagaaacaacactattggacttgaatattgcataccttacaacaagcaaaacatttaagcttgaatttaaggtattttgagtattatctgcatttagaagggcctttggagatttatttctaaagtcagttgattgcctattaagtctttgttaatttcgtactttccataacgaaggatatagaataaatcttggtcaagttgatggtttacctcttaaaactgcgtgccaatatctttaataattttatcattttctgtgaacttaaaatacagaataagttcagttagtacatttcaaaattgctcattctgaggaatctaagtaaaaattaatggatgcattaaatttaaaagtatgaaccttaagaaaaggtagaaatggaatcagagagaatagtattagtaatttcatacttattgctaaaattatggtacaaaactattaagaagtggtgaaaaaaatgtgactttcatttcatgaactttaattttgtgaattatagttttaactcagcttatcccagaaggaactgtgatcgctttaaactattcatgtataataaagtagaatttataaaatgagagtatttttattattttattaatttaccataagttatttcagcctaaaagtttgtattttggacactttttgaagtttttttatattctgtttttaattaatgagaatatagtttttttctaaaaacttactcatgattttttctatgtcatttttattcaacattattttataagagaagctattaagccagtaatatcaaatacttaatctttttttattttaatttgtaccattgtcaaaaatgttgccaaaagtttagtaatataattaggagctctgatggaatgaaaatatgtagactttattttgatcatttggatgctatctttcatagacagtaagctattaaaatttggaagtaggatagaatcatttgtatttaatcacaaagttaaagtagctctgcaatgtaaaaataatttttaatatgtgttgttttccactattttgaaaggcctaaggaatatttttcaagttgtatgtatcaagtttgaaactaaagtaaggaaaatctagactttgacccatttagatcttgctaaaattgtttttaggagtgctgaattaatagctttttaatgtcactttattctgtttttaatggttctagaattgttagatgtatgtaggggcttcaaaatttgatgtttcatatttagtactgttacatatatataataaggaggagtagattttcaatttagattacatttgtgtttttataggaacagcattaaaagaataaattataggcatataatatttaggaggcatatattgtttgaatattatttatggtcagaggacagagtttattaatctattcattgcatagttcatgcatagtattcatgtgaacttaaatgttatcctaaaagactatacagtggagaatcaaaaattttaagtgtatttaaaatgtaagcaataggtccaaatactgttgccttatctttatatatgattttcttttaataaggaaaaagagggggaaatacccatttatttcccttacatataattttgaaataaagcatacattgcaaaatctagatatatacaaaattcatggcttgaagttgtcttccattgaccctgcagaaattagagtatttactaagattttatttccatgatgtatgaaaacctgtttttatagtcacttaggtgttctctgtgtttctttttttaatcctagatcttgtatgctaatttgttttagaaacaaccactatttaatttgggaactgtagtttatgtgaactcattttatgagtaatatatgttttatgttcttaatttttctgttattaaatttagtgttaggatttaccttaaaatattgaaagtgatagaatttgaagccgttttaattaaagctatatggttaagtattttgtatctattaattgaaatctgtaaatagatttttatataattgcgattatgtaatataactgatcttgtgtactgtttttccatgaaccttgatgcttttttaaattttaaaaataattttattgttgcagatttatgttgcacaggtacaggtttattacatggatgtaatattgtgtagtggtggggtttgggcttctagtgtacctatcacctgaatagtgaacattgtatccaatagataaattttcaaacctcataatctcctctccccccacctttttgaagtccctaatgtctattattcatgaatcataacacttttaatggcttcataataggttattaagtgaatacagtgggtaggtggttaacattatttcacgttacacttcagcttaacacccactaaatagtggtaatttttcttgttttgttgttttttgtcaatggtattttttgactgaaataattttgtttatattttatagtggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtacaaacactaattttaatttattgctccaataggagttataatttattatattttctggggactagtctaaaaatgttctcaaagcatgggtttttttaatacgttttctttgggaatagtctacttttaaaaattgtatatgaatataaagcaggaatgcagaatatgtcattctttgattctttcaagcatgagtagaatactgcagcagaaaatatcaaaacaaatgattggagaggatttggtttagattaagaaactataatgagtgtttacaagcatggattctagaggcaggctgcttgggttttaaataggtcctgtcacttagctgagtgacctttgataaattacttaacccccttctgtctgtttcctcatccataaaattctcataataataaaagctacctatagggctgttgtgagggttaaaggggtaaatatgtataaaagacttatatactgcttggcatataagcttgatgtaaggattaacaattgtcatttctcagtgatagctgaaaatttaaagtataatttatatgaaaatgttcttggcactttgaaatttattttggaatttattttttttctaagaaatatttctatatattcttcttattaatttaggtggttattccatgatacttctctattttaatgcgtgttttaatttttaaggtggaacagaaattgtcacagagagtgagtacaccagtggacattcagtagctggagtgcttgaccagagccgaatgcagcgggagaagatggtttacatggcagttaaagattcttctcaagaagaagatgatatcagtaagaaaataagggcactgtagtgacttatcagtagccatcatgcattatttttaaaaaatctcagagatacaagcactgtataggaacaaagttcaataaaataagcctgatcctttgaccctttgctgtaaataatttaaaagtgaagggtccttttgaccattcatttgtacatgtattgttcaaatcaccaaacattaaataatatatcttagtatactatactagaaatacagagatgaacaacatacagctcctgacatcagtgaagctcaaaaatatgtaattactgagtacctactttctgtgcgttactgaatatgttgcaagatactatctcatttaattcttacaactcatatctgaggtaggtggtatttttcctgtcttatggaaggaaaaaaaaagattcagggaaaataatttatccaagatcattccaatattaagtgtgaagggcaggattttaatggttatctaactccactgccaatgttctttccacatggcagtgggcactgttggcttctctctggatttagcaattgaagggctgatggtttgttctcctgtcactaaagggttatcttatgtaagtattcttccaagccaagctgccaggagtttgatttcctatgctgttgatggtctccaagcagttgctgcttaaggttttgtggggctaagtaccacaggacgatcaaacctcctcaggtttcctttcctgccataccgcaggtttccttatgaagacattttgctctctgcctactttctcctcacctcagtataggaatgcagccctttcctaaggctattcctgtcttcttactatgctgagaaaaacacaatattgccttgccctagaaggctaagagcctccatttcactgcattaacttgacaatattgggctttacctgtgctgcactctgatacctactccaagtttccttccctagaagttgtagggtgctgaattccacccccaaacagctgaaaatatcaaaacaaatgagtggagaagattctgatggataggaaaagagtttaatcaaataatttctatttgatctctaaattctttatttttttatttattggtaaggaaaggggcacagtaggaaatggaagattgaggtttaagttaacttatgccagaattctatgggaatgtgggaaacttagaccagtgtctctttttggttaa

SEQ ID NO: 877 - DNA, 31 bp, mus musculus
cctagcttccgggcctctttgatgattaggc

SEQ ID NO: 878 - DNA, 210 bp, mus musculus
gagggccccctcaagggcatcctgggctacactgagcaccaggtggtctcctccgacttcaacagcaacacccactcttccaccttcaatgctggggctgtcattgccctcaacaaccactttttcaagctcatttcctggtatgacaatgaatttggctacagcaacaggatggtggacctcatggcccacatggcctccaaggagtaa

SEQ ID NO: 879 - DNA, 210 bp, mus musculus; identical to SEQ ID NO: 878

SEQ ID NO: 880 - DNA, 54690 bp, mus musculus
cccctggcgttgtaaaggcgacaatttgcccagagaaatccaccatcgcttcctaagtggggcacaaacacagccaggggaggcctcctctaaatgttcgtgaattctggttctggaatcgcgaagaaatgggagcggccgcgcgcttgtgattctcaggcctttgctcctcccatacacgtccacggcgcgttacgtgggagaacgttttcgcccctttttttttttttccaaactgtgggaaaaggtgctagaaaatatgattgcgggtagagacagggccgctggcagagtaactcaattttaatagagtcgggtgtatgctgaggtcgtcaccatcccccaaatcctgtcagtcccacacaaaaacggcccttaaatcccctgccacgggctctcatatagtttttgtccttgctcttgcagtcaccgctctattctgaagggcttttcagttcatccatgcctaccgacactcccgtcccccccatcaaagtccacgtttaattttttgtacctgctttaaaacagcgattctcaaccttggctgcactttgcaattatctgaggagctgttttttaaaaaaatacttagatatatgggttccacccctgtagattcagatttaattggtctggcttgaggtctgggcttggggaatttttgaactttcctaaggtgattctaacatgccctaacgtagagattcactattagaagcattcgttgctgcgacccctttcaaacatctttttgcagtttcatctcctcttggtgtaagagatgttcatgatgttccctaaggttagaatattcttactgtcatcacttgggtaattctttatcattgttgaaagcggttcatctgcttctgaaggtgtaagctcacttgttccctcccttggtggtcctaaagcacattgaaacagaatatcattgtgctagttattaaaatgcattgggattatttataccccttacagatacagttgctggaaggcagctaccttatttttaaatattatttttatttttaattgatagtatatacttatggcatacaatgtgatgttttgaaacatgtaaccattgtggaatgagcaaatcaggctattaacatctatcaaatgatatacatacttacttcttttggtgagaacatttaaaatccacttttagcaactttggaagatacaaaaggttattgctaattgtagtcacattgctgtgcaatagatcaccagaacttattccgcctatctaactgaaactttgtaccctttgactaatatttcccctttctccacccactgtcctacccggcctctggtggtaaccaccattctactctttactttttttttttttttttttttttgagacagagtctcgctctgtcgcccaggctggaatgcagtgacgcgatcttggctcactacaacctcgcgtcccaagttcaagcgattctcctgcctcagcctcctgagtagctgggattacaggcacgtgccaccacgcccagctaattttttttaaatttttatatttttagtagagatggggtttcgccatgttggccaggctggtctcaaactcctgacctcaggtgatccacccaccttggcctcccaaagtgctgggattacaggcatgagccaccatgcccggcctgaatttcattcttttttaaggctgaatagtattctgttgtatatttataccacattttttaattcattcattggttgatggacactttgattccgcatcttagctattatgaataatggtgcaatgaacatgggagtgcagatatctcttcaacatactgatttcagttcctttggatatatacccagaagtaagattgctgcatcctgtagtaattctatttttagtttcttaaggaacctccatactgttttccaaaatgggtgtactacaaatttacattcacatcaatagtgtacaagggttcctttttctccacaccttcaccaacacttgttatctttcatctttttgattatagacattctaacaaaatttgtttgctccctacacaaattaattgtgtggttttaatttgcatagagaggcaggcaaaggctactctgctaatggctttagaggccacagtaagaagtttgggttttattctaaatgcaaagccattacaatgttctcatttttttctaggttggtcagaccatgcccatggttcctcctctcgacttcactatgaatgccgcatctgttgaatgaatgcagtttctgctcttgcttttggatagaagtgattgcaaatcttatcaaaataatgaaaaaaattacttttcaattccttttcaacccttttgagtctgaggggcagctgtacattaaatgaaaccatatgtatcataatttcatttttccatcaaaagagctttaaaggaaattcccctttttctccatgttttcaatattttttgttccttttgttaaaatcagattaatctcatgaaacatctgaagcatttaagtcaatttaagagctgagaaaatatcatgctgctagttctgaaacgatctgaagtgtgaatcaggtgatcaccaaataggggaacaactgaaaaatgtgaatgaaagaagtatgtacctatactatagtgtcaaatattgtactgtaagctttaaaatgataaattggaaactttccaaaagtggtttgaatatgggtcatttatttagtaactcagccaaacatgctaacattttctttccttccccattaatttattttactagcccttcctatgtttgccaagtggctatgttactgaaaccagcccaattgtcccatagaaccgatgtttacagtcttctaaaataaacatagatattgacccttccagttttaaagcttgaaacttatatttgtcttaactgagttccttcctcgggaaaataaccttcatgcctcccagatagtttcaagaaactgaaaccaggtcaccatatctagacaatgagaagccaggtccctcatccttcatgatttccttacctctccctaattcctgtttacccacatgtagttacattcctttcccactatataaacccccaattttagtcagtcagagagatggaatgactacttccctggcaacagtcgttgtctcagtgattggctttctgtgcagggagcaatggggacctagaccaaacccctggcattttggtaacactatctggttgggaggtgggatatcactgcactcaggagctttcatttactttacctctctggtctccaataattcaagcacagtaagtttcatagtcctattgctgaattttcaccttatttttctttagaacattctttttgataaatagtacttttccatttttaaagatacctattcaactcacagaaatttcaataaactccccatctcctgccacttattcccttactacactgtaacttcactacatagtacatgccattccctcccactgaagatagcttgcattatgttgcagatacttgaaatattgtttcctggctggcttctcatccttcaagtatcagtttaatgataaaatcctcagagaggctttcctgactatattacattaggcatgtacaaggaacttcattgcagctttatttgtagaagcaagaaaatatgaacaatcttaactgtctctcagtaggagaatagataagtaaactatatttttgcccaggcatggtggcttatacctgtaatcccagcactttgggaggctgaggccagctaattgcttgaggccaggagttccagaccagcctggccaacatgatgaaaactccgtctctactaaaaatacaaaaacaacaacaacaacaacaacaacaaaaacaaattagctgagcgtggtggtgcaagcctgtaatcccaactgcttgggagaccgaggcacaagaattgcttgaacccgggaggcgcagttgcagtgagccgagatccgccactgcactccagcctgagtgacagagcaagactctgtcccaaaaataaaaataaataaataaataaatatatttttatgtaactgttcaaatgtattacagctacgtaaactgacatgaatacatcttaaaaacaatactgaataaagaaaagcaatctttctgataccacttgtgtccattttaaaagcacacaaaagccgggcacggtggctcatgcctgtaatctcagcactttgggaggccgaagcgggcagatcacctgagcccaggagttcgagaccagcctggtcaacacaacaagactctgtctctacaaaaaatgcaagaaattagctaggtgtgatggcatgcacctgtggtcccagctactcgggaggctgaggtgggaggattgctggagcctgggaggcagaggttgcagtgagctgagatcacaccactgcatgccagcctgggcaatagagcaagaccttatgtcaaaaaaaaaaaaaagagaaaagaaaagcacacaaaataatactctataatttagtatattgtgtagtaaaagtaaaaaatataaatggggatgatatataccaccttcaggatagtagttacttctagggagggctaaaggataagatgatgctttattggttactagctattttatctaatggatttctggaagaaaaacataaaggaaatgtgacaatattaatatctattaaatcaggggatagagatctgattgttaatatattctgtacttttcaatatttttaaatatttcataattttaaaacatttaaatttaaatgtttctatcagtataatttacactagctaccattacaaactccaaaatcttggtgacttaacagagtaagagtttatttctcatgctcatgaatctcaataaagatgtacctgatggggatggtcctctaagtagtaactcggagacccaagcttcttccatcttgggaagccatcactatatgagaattttttttgtgtgtgtccacccatgttccattagccagaattagtcatacagcccatttaaaggctagggacctggaaaatatggtcttcttgtgtgcttagggaagaaatgaaatagtatgatgaacagatagcattgtttttaccacaatattaaagtagtctcctctttttttccccttagagcacagcccctgaaatcagactgcttagattcaaatcctagctctaccacacactatctgaacgctctccagcaagttactttactttgcgtgatctcagtttcttcatctgtaataatactgcttacctcaaaggatgattgtgaagaattaatgagttgacatgtgcaaagggcttaaaatagtaagtggtcttcatcctttgatgatcaaacagtaagtgatcatcatcatttaggatcagtaagtcttgtatttgcttattcacctaataacctgtgaactttcttcttctgtcctcatgtggctatctttctgatctccccacctaccatagtgcctagctacctggctttaatgaatgaatgggatgaatatatttttgcaccaacctaatatttcttcatttatatgctatagttctatttgtattacatttacttttgtaggattaatattgacttacaggctgggcgcagtggctcacgcctgtaattccagcactttgggaggtcaaggcaggcagatcaggaggtcaggagttcgagaccagcctggccaacatggagaaaccccgtctctactaaaaaaaaatacaaaattagccggatgtggtggtgggcacctgtaatcccagctacttgggaggctgaggcaggagaattgactgaacccaggaggcagaggttgtagtgagccgagattgtgccattgcaccccagcctgggtgacaagagcaagactctgtctaaacaaacaaacaaacaaacaaacattgacttacatatatttacatgaaataaagtgtcaggatttttttgtggaggggagaggggacagggtctcactctattgcctaggctggagtgccatggcacaatcatagctcactgcaacctctatcttctgggctcaagtgatcttcctgcctcagcggagactacaggcacacattactgcacccagctgatttttaatttttttttttttttgtaaaaaggaggtcttgctatattgccccagctgatcttgaacacctggcctcaagctggcctcaagcaatcctcctaccttggcctcccaaagtgttagaattacaggtgtgagcctccatgcctggcctcaggatttttttaaaaatgcttcagaaaaaaatgttggggagttacatgaaataagattagcagaatgttgacagttgttaaagctgatgatgaatacatgggcgttcattatagtcttcttttctgtgtttcagaatatacataataaaagttcaaaaaaaagactggaaatggggagccaactaaaggcccagatcttttctctttcctaatgaacagcctttaatatatatctattcattttcagatttaaaaatttctaatttacagagtgtctaacataaaaaagaaaactacacggaaacttcaattataattgcctatgaaagagataaaagtgtcaaatattttaacagttttggtttcaggccttgaaaagaatgtttctgaggaactcttaaaaaaaacttatacaattttataatcttaaaattttctagctatgctaaaattcagtgtcttttaaataaatgttttctaatgggtgaacaaaagaagaagaaaaagaagggcattactagaaatagaaacgaggaggagggaaggagtccatttagaattattatattcttcattaagagataaaaatcttgtcttgccttgttctctttgttggagaagagccccctcacctctggaaggggcaaggagtaaacctgccatccatagctgctcaaaataaacaatgaaatcagagtaagacaccagggcaaatagcaggggcatgagcatggtagctctggttccagtgcctccaagtctcacggagtgttgtgatgagcatggagactatatgcacagtgagttgtgccatagctaatggaacccagggctgagggctccatgcgttaattcttaccagtcagattgaagcaaagttgccttggtgcacatatgaggaaggagctgaggtgtcatgcacagccaaatagtcatgttattgtgagggtgtcaggtatggctaaacagtgctgctattgtgagagtgtcatgcacagtgaaatagttcagatcctgccatacctacatgagtgttctgtttttatagcatgaggatggggatggtaaacccagcagcagcgttgtgttgccaattgcagctgccgcctgactcaggtggaccatgtgattgttttgccatgctgcagtgctacatctaggggacaaagaaagcattaaatgtttccccccttcccacacctcctggagactaaggtattccttccccaggtcccaggtttattgctctttccatatagtccatttgttttaaatcagtagccactatttctcctttcgcccagccatccaccacctctacccagatggacgaaggctcatgggaactgggcaccatgggtagaacttgcaacagcctgtgatgtcctctaacattgcccaagcaggccactgtagggatactctagtgcccatgaatttcaccaactattatcctcatggccagcactcttccatatccaacacctgaaaccaagtcatagcagaagcaaaaggttgcagtcaccttcctcctgttgcctaaccttaggctgaaaccagtcaggcttaccaggcactaagggccagtggaaaaaaagaataggggtggctgaagattgtcaggatgcaatcatagatacatagcaccagtctcccattcctcctaccccttccatcctggccttccctaggcaatgggaaattttgaatataattgatcagaaaactctttcagtcatgtgcatattctaggaatatctagtgtaggtaaattgtcacacatgtctatgagaaagaaaaaatttaataaactatttatttcacttaaaaatatagagacaagtaagtttaaataatagcctttgttactgtagttacatccagtgaggagcgaagggggaagagcccctcataaccagcagatcttgtgaaaactcactcactatcacaagaacagcatgggggaaactgtccccatgatccaatcacccccaactgggttcctccctggacatgtgaggattatggggattacaattcgagatgaaatttgagttgggacacagagccaaactgtattattctgtccctgacccctcctaaatgtcatgtccttttcacatttcaaaaccaatcatgccttcccaacagtcccccaaagtcttcactcatttcagcattaacgcaaaagtccaagtctcatttgagacaaggaaattcccttctgcctatgaacctgtaaaataaaaaacaaattagttacttccaagatacagtgggggtacaggcattgagtaaatgttcccattccaaatgggagaaattggccaaaacaaaggggccacaggccccatgcaaatccgaaacccggtgtggcagtcattaaatcttaaagctccaaaatgatctcttttgactccatgtctcacatccagagcacgctcatgcaaggggtgggctcccacagccttgggcagctcctgcatgggctggcattgagtatctgaggcttttccaggtgcatggtgcaagttgttggtggatctaccatcctgggggctggagaacagcggccctcttctcatagctagctctgtagacccttaagattggggataggacctatagtcttagtttaattttggacacacttgtttcctaaaagtatactacaaagtctgattataaaatcttctgttagtatttgtctgggttacagtgttcatatgtgtgatcttcagagtcttaaatgatattattcagtcactgtcacataaattgactcaaaagttcatcttacagtgaaagaaacatgaaggattgactttaatccaactatccgaatagccttcctatcaatggaactcagacagtggcgcagatctggatttcacaaaataatgtcctgtggtccgaattttatagcccttggccaaaagaaaggactaagaaagtacaacctagctcagagtgagaaagtgttacagaaatctgtccagccattcattagactggaataatacacagataaagtcagctacacagttcagtatcaggggatggttaggccttagtgtggcacacttagcaagactgtgcaaagatctttgagacctatggcggactacctcacctgtaaaccagtagaaagatttgtacagaattcatttttacttccagaaaaattagcccattatttctagtgatttttgaagaagatagaattgagccaaaagggaaggaaacttcaaattctaggataaaagtaaagcttagagagaaaacaatgctcctgaagaaaatatggattataattttagttttgctttgatatttatgaaacatgccaaaattacttcctttggatgttatcaaaaggcataaatgaaatgtgaaaacatttaggtctgcattaaaaaaatataggaggaaaaataagaggaaagattagagccctccaaaccagagataataggctaaaatttgaaagaaaatataaaatcagtatattttagacaattagaaacctaaaagaataattgaaatgctaagaaaagaacaagacaatatgacaaaaagaaaagacagactagggaaaaataaccatagaaatgtaaagattaaaaaattcggaattgcttctgaaaagcaatttagtgaaaagctagaaagcagattagacagctaaaaagagaagaaataaactgtacaatagacttaaggaaatttttcagaatgctgtgacacggagttacccaaagactgaaaatattaaacaagttaaaaagacctagaagataaaacgtgtaaggttcagagcagtgtttatggaatgctatctttgatgtaagaaaaaggaaaataatatgtattcatatattattatattaccataacaaattcagaggatacacaagtagtacatctgtttgaatgtggttgtggtgagggaaatagtagatttgggcaagggtgggactgagacttgcattactgtatacattttatattggtttaattcacaaaccatgtctgagtcctctgagaagcagaagccaacatgggattggacatgcaaggattgattggagaaatcctctgagggtaaaaggggagggagggatccccaagaggtgggaagaggcttcaggccactctgcaggtctgataccaatgaaaggagcattgcataggcagagtctaagactgcattgagattctaagaaaggttcggccaagttgatgaggcatcctgaagccaaagtagcctgtcagaggagtcacatgtcttacaggaatgggtctaccttattatccctgccatgcggaatcattgactgaaagcagcctgtgtgaagtgtggtctccatgttaacaggcggtagattcgtagcgcagcagctgaggccatctgtcaattatgcttcctgtagcaagagatctgagtggcgtattttcatagctgccacaccatgggactacattttgtattcaaagaagggcaaaataaagacattttcagacaaagattaaaggagcttatcattcacagactgtcaccctgaaaacctctaaaggattcactttagaaagaactgttttgaatcctgaaggacagtgtaggatgcaagaagcaatggtgagcaaataaattggtaaacctgtgggaaagaagttagtaaatatgcagataaatctaaatagacattgactattaaaaaaaaactaagaaaatggaaaaaagcaagaaaaatggcaataatgattgagtatatttttaaaagatggagttaaaatattagcaataacatgaaaaattggaaggagaaattggaggtagagtatttcaaggtccatgcgttagtcagggggacagtaaagatatagattaactttattttatttttattattttttttttttggagtcaaggtcccactgtgtcacccaggctggaatgcagtggcactatcacggctcactgcagtctcaacctccggggctcaaacaatcctcctgcctcagcctttcaagtagctgggactacaggcatgcaccagcacatgccactaatttttttgtattttttgcagagacgggggtctcactatgttgcccaggctggtctctcaaattcctgggctcaagcaatcctctggccccagcctcccaaagtgccgggattacaggtgtgagccaccaagcccggccaatatagattaactttagatttcaaaccaagtatgccaaatttaagagaaactactacaagagcacaaatgggttatatgacttccaagccagaagaggaaaaagaagagaaaaaatgaagcatggcgaatccaataattggcatgaaatgaggaggaaaaaataaagcaaaagaatgggaaatagcataaattaagaaaaaaagaaatactaatatatcagtaatcactataactatgcattattttatttgcactagggatatcccccttgtaaagagaccaaataaattgcaggtcagttcctttaactctttccttcttgcaaatgtgtgtatgggcatgcatgtgcatgtgtacacacgtgtacatttacacacatatttgtttccacatctgtctctctctctctctctctctctctctctctctctctctctctctatatatatatatatatatatatattaaagccatgagttcatactgatacctcatatttcaatccaacaccagaggttcattctagtcttccccctttccatatttgtaacttccttttctgacagtgaacaatctggctcaatatacttatttgctcaatcctagaatacatagaaagtcgtttcagaatagataatctataccattgtgaaaaactagccttctgggtttggaggacagtggcaatactgcctcattctgaatctccctactcacccctctctccacaaataaacctcatgaaataaagcaacatatgactgatatagtttagctgtgtccccatccaaatctcatcttgaattgtagctcccacaattcccacgtgtcatgggagggacctggtgggaggtaattgaatcatgggggtgggtctttcttgtgctgttctcatgatagtgaataagtctcacgagatctgatggttttgtaagggggagtttccctgcacaagttctctctcatctgctgccatgtaagatgtgcctttcaccttccaccatgattgtgaggcctccccagccacatggaactgttgagtccattaaacctctttttctttataaattacccagtctcaggtatgtctttatcagcatcacgaaaatggactaatacagtgacttattccttcatcagtatttggtaaaagagaatattctgatgtttaaattacttgtaagcaaagaaataaaccaaattctaatagagctcctgccatctgcctgctgctgcacgcctgtgggtgcagagtgcagaggagaagaggcgtaaagaaatgccatgaaaaaatatagtggggcatagaggacttggataaggcacggacaaaataacccttagaaagagaaagccagataagataaatgccaaaatatagaatataggtcaggatatggtaagttcatgttagtttgttatgcaacgatagaaaacgaatatggattttagtacctgaaagtgtggtgctgctataagaaatacttaaaaatgtggaagtgtctttggaaccaagtttgaagaggattttgtggagcatgataacagcctaagttgccttgaacagaatgttagtagaaatatggactatgggaaggcggctggtgaggcctcagaaggaagtgaggctcatgttataagaatctggaggaagtgagatccttgttatgtattggcagcaagcttagcaaaactgaaacttgtgtcctgcagttatttggaaggtagaatttgaaagcaatgaactcacatatttagctgaaaagatttccaagtaaagttgtttttgcttgttgttttttttttggtttttttttgttttttagaggcagggtctccctctgttgcccaggcaggagtgcagtggtgcaattatggctcactgcagcctcaaactcctgggctcaaatgatcctcctgcctcagcctcctgagtaactgggactacaggcacgtgccacaacacctggctaatttatttttatttttatagagatggggtctcactggattggtcaagtaaagtgttgaaggtgccatctagtttcttcttgccgattatagtaaaacccaagaagagagtgacaaattgaggaaaggactgttaaacacaaaggaattgggtaattctcagcatatcaagattgacgaagacactaaaattaagagacaaaaggttagagtatttgatcacaagaggtttatgctgtgcctcacagatctcattcaaatcagtggcttctaggaagcttaagggtgtccctgagccatctcagcagcagccaaagctagagaaggaatgatctctaccagatttgtggacatggcttctgttcaatgtagtgaattcctatgacatccactcaaagcagacaaggttcttgagaaatttgtatcagcagaaatactgccagcttggactgaaagtgacagagtttgaagtgaaaggaagctgtcaaactcccagaattcctctggcagaaaggaggttgataaaactactcagctgtaaacacattctacctttcatgaaaaaaggacggctcagagagaggaactgaaagcccagggggcacaggcgagagccagagggcagaactgaaaggcacgtggaattatttccaagtcttgaaacccaagggagtttcccagcttttaaaactgctttggactggtgatcctttttaccttccattttcctcccttttgaactagaatgtctgtaactcttaccctatgcctgttccatcatcatgtgttggcaatagataacttgtttctacagtttcataggtccacagatggagagaaattgtgccaggcgtctcacccacacctaatctaagtgatttgatgatgagatattggatttttgaattcatgagatttagatgagagtttggactttgagtttaagctgtaatggtattgacacccttggcaaatttgggagaaggtgaatgtattttgcatttaggagagacatgaatcattgggggccagagggcagactgtggtaaacagaattgttctttttatttttttatttttcttttgagacagggtcttgctgggtcgcctagactggagtgcagtggcgtgatcatagctcactgcaacctcgaactcctgggttcaagtgatcctccctcctcagccttctgagtactgggactacaggcatgcatcaacacacctggctaattaaaaaaaaaaaaaaactgtagaaacaggagtctccctgtgttgaccaggctggtctcgaactcctggcctcaagtgatcctcttgcctcagcctctcgtagtgttgggattacaggcatgagccaccttgcctgaccttgatgtttgatatatgtttacattgtggaacgattaaatcaagcaaattaacaaattcaccacctcaactacttaaacatctccgctttccatgtctacccctctcctccagcctctgggaattgccattgtactctctacttgtatgaatttgactttttaaaatttcacatgtaggtgagatggtgtgatatttgtctttctgtgcctggcttatttcacttaacataatgtcctccatgttcatccatgttgtcacatgtgacagaattttattctttttaaaggctgaatagtattccattgtgtatatataccacattttaaaaaatccattcatccattgatggacacttaccttgctttcaaatcttaccctctgtgaataatgctgcaatgaacatgggagtacagatatccactttgacatactgattttaattcctttggattccttttttttgagacagagtctctctctgtcacccaggctggagtgaagtggcgcgatcctggctcactgcaagctccacctcctgggttcacgccattctcctgcctcagcctcccgagtagctgggactacaggcgctcgccaccacgcctggctaatttttttgtatttttagtagagacagggtttcactgtgttagccaggattggattccttttaatcccagtagtgggattgctggatcatatggtagttctatttattgtggggctttttgaggaaattccataatatttttcataatggctatattaatttatatttccaccaacagtgtacaagcattcccttttctctacacccttgttaacacttattatcttttgtttttctgataataattctattatcacctattctattatagatttcatgatattctatcatatcacctcacattcgggtgtaagatgatatttccattgtgcttttaatttacatttccctgatgattagggatgataagtgtttttcatatatctgttgaacattggtgtatctgtttttgagaaatgtcaagtcattggtccgtgttttaactagtttgtttttttttcttgctattgagttgtttgagttccttattttggatattagtttcttgtcagatgtatggtttgcaaatattttctcccagtccttgagttgtctcttcatcctgttaatggtttcctttgctgtgtggaagctttttaatttgatccaatcccatttgtttatttttgcttttgttgcctttgcttttggggctattgtggagcatttcccccatgttgtggagcattttcccccatgtgttcttccagtagttttacagtttcaagctttatgtttaagtctttaatccgctttgagttgatttttgtacatggtataagagtccaagctcattttgcatgtggatgtccagttttcccaacactccttattgaagagattgtcctttctcattgtgtgttcttggcatctttgtcaaaaatcaattgattgtaagtgcttggggttatttttgggctctattctgttctattggtcaatgcatcttttttaatgccagtaccatgctgttttgattactacagctttgtaatagattttgaagccaggtagtatgatgccttcagcttttgcttttgatctttgggctccagtttttttgctcaagattgctttggctatgcagggtcttttgtggttccatacaaattttaggattgctttttctagttctgtgaaaaatgacattgtaattttgatagagatttaactgaacccatagattgctttgggtagtatggacattttttaacaatattaattcttccatacatgaacatgggatactttttcatttatttgtatcttttctatttctttcatcaatgttttatagtctttagtgcacagacctttcacctccttggttaaatttactcctaaatattcaattttttgatgctattgtggatagcatcaaattttcttaatttctttttcatatagtttatttttagtgtaaggaaaggctactgatttttgcatgttgatttggtatactgcaactttactgaattcatttattagttctaacagttttggcatgagttttttgggttttctttatgtaagattatgttgtctgcaaacaggggcaatttaacttcttcctttccaatttggctgtattttatttctttctcttgcctcattgctcaagctacgatttccagtactatgttgaatggaagtggtgagagtgggcatccttgtcttgttcctgatcttagaggaaaagctttcaacttttcactgttgagtatgttagttgtgggcttttcatatatggcctttattgtgtttaggtacgttccttctatgcctaatttgttgagagtttttatcatgaaaggatgttgaattttctcaaatgtttttcctttctgcatctattgaggtgattgtatagtttttgtccttcattctgttattatggtttatcacattcattgatttgcaaatgttgaaccatccttgaatcccagggataaatctcatttgatcacggtgaattatccttttaatatgctgtttaatttggtttgctcatattttgtttaggatttttgcatctatgttcatcagggatattggcctggaattttcttttttggtagtgctattgcctgactttggcatcagtaatgctggcctcatagaatcagtctggaagtatttcctcttcttcatttttttgggaaaaagtgtgaggaggatttgtattagttatttaaatatttggtagaattcgactgtgaagccatctggtcctgggcttttctttgatgggagatgtcttattattgagtcaatctcattgcttattattggtttgttcatattttctgtttcttcttgattcagtcttgttaggtgtatgtttctaggaatttatccatttcttctaggttaaccaaatttttggcatataactgcacataacagtctcttatggtcctttgtatttctgtgacatcagtaatatctcctctcttatttctgattttctttattttagtcttctctctttttttcttagttggtctggctaaaggtttgtcaattttgtttacattttcaaagaaccaacttttagtttggttgatgttttctatcatctttttagccactatttcatttatttctgctctgatctttattatttctttccttctactgattttgggcttagttcgttcttctttttctagttccttgaggcataaggttaggctgtttatttgagatttctttttttttttgatgtaggcatttgttgttacaacttcctttggtgatgtctgtgtagccttgcatttgaaggagcaaacccttctttcagtctttacagatacattttggcaagttaaagtgttctcctgttaggtattgtattagtccattctcacgttgctataaagaaatatctgagactgggtaatttataaagaaaagaggtatagttggctcacggttctgcaggctgtacaggaagcatagtggcttctgcttctggggaggcctcaggaagcttccaatcatggcagaaggcaaagggggtatgaggtgtctcacatggtgggagcaaggagcaatagagagagggaggaggtgctgtacacttttaacaaccagatctcatgagaactctatcaagaccatgaggacggtacaaagggggatgtgctaaaccattcatgagaaatgcacacccataatccaaccacctcccaccaggccccacctccaacactggggattacaatttgacatgagatttggtgggggtacaaatccaaaccataccaggtatctgggttgatgagattgcctccaggatcccagttgagtagggttgaatctagatcatgttgctggtgccgggtctgcagtggagaccaaagttagtgggcatgggtcctatatggttccctagtggagtggactatttccaggatcttggtctgtggggctggtgctaggatgaggatccacttcaggattcacagatggcaggcctgttaccaggtgcactgatgggtgtggcttcctctgtgattctgagagagctgctgttggatcactggatgagtccctaggctggccatattgctctggtccatggctgagaggggctagaacagagacacaggattgtttcagggtccgcagctgagatcgagatcttcagtcctgtctccagggtcaggggtgggtgtgtctcccggtgggcttctgggtgagcagacctgccatcagactgcaattgagaagggctggagtctatttatagggctgtttcaagatccacaatgagatcgaggtcaaggaatcagccttcagggacactgcgagacatgcctccctccaggaccaagatccagggactcagaagggcacgtctcctggcgggatcccagctgggcagaactgttcccagaccacagctgggaggggctgaaactgagcttcagtgctatttcagaaactgctgtgtgactgatattggcaagcccaacctggtggcaccatcaggcaagactcccaacagttccctatgtgggaaggattgctccaggactgcagctgagaggggctggagctgagattcagggctcctttaagaaccactaggagacagagtttggcaagcctgtcccagtgtgtctcccagcagtttcctgcataggtggaatagctctggactgaagctgagacagagccttttcagggtctgctatgggatgtaggctggcaagcctgtcctggtgacatagacagtcacgtctcgcagcagttctctgtgcttttgggtttgttcccagactgggctagagtcaagcttccgcgccccttcaggatctgctgtgggaaggaaactggcaagcctgtcacagtggctcagacaggctagtctcccagcagttctctgcgtgggtggaaatactcctgggctgtggcagagaggagctggagctgagacagggccccttcaggatctactatgggatggaggccagcaagcctgtcccagtggcacatatgggcaaatttccctctgggtccttgtgcaagtagtactaatctgggaccactattgagaagggctggggcccagttacaggatagcttttgggtatactacctagaccaattttggcaggcctgtctgttgaggcactagtgtgcctgattcctcccagacccttggcaaatggttttggtagcaggctcaaggccaaatggtgttgtagccaaacccttagaagaacagggctatttccaggtatgaagccaggatagcagtcagctggtctgccacctaggtatgggtctgcactctcaaaatgaccctcctaggtcttgggctccactgggtttcacaacttcctaactgtatcccagggatcccacaaagacacttttgtctgtggatgggtacagaattcttgttgtgggaggatatgagcgagggaacctcctattctgccattattgctctctcctgtttcctgttacaagttttttagcttaaccttttatatttaggtctctattccattttgagttaatttttgagtatggtatgcatgtagatatccaattttctcagcactatttgttgaaaagactatctgtcctttccccattgaaatgccttgcacttttgtcaaaagccaattgaccataaatgtaaaggtttagttctagattctcaattctgtacctttgatctgtatgtctgtctttatgccagcacaacactgtattgataactgagctttgtaataagttttgaaattgagaggtaaaagtcctccaacttcgttcttcattttcaaaattgttttggatatactggatctatttcatttaatttcaggatcagtatgaagtcagaaactgtgaagggtctgagatttcaccctacttgcaaactaacaaattagtttgtgaacagtttcacatatatatgctgacagaagatatcagacccctgtgttaaggacagatggtttataactcatggcaaaagcagcatccggagtaccaactcactagtgcctaattccccacgccccagttctccacagggcaacacaaatgagagccagatgtttacctgcataaacaatgggtttcaccataggaaaaaaaatccccaaattaggaggctctgaagttatgtaaggtttgctggcacatctgcccatcctcccctttaggaagggagagataatgactttatcttttctcttgaatataaacaaatcttcactggagaggggagtggaaggcctctaggtttattatcctgaaatgtaagcaaatgtctactgggtatacacagctcgaaatctctagcttccaaggcctttgccattcaaacatgctctttgttcagaagacctggactgtgtggagctgtgaaatattcatggagaattgtctcccagcaatcaatttgtcaatttcctcaaaaaaaatctgttggaattttgatagagattgtgttaatctacaaatcaatttggagagaattgccatattactgagttttccaatctatgatcatgggatgtctctccacatatttaggtcttctttaatttccctcatcagtatttttaaattttcagtgtacatgtcttacacttattttgttaaatttattcttaagtgttttattctttttaatacaatcataaatggagttattttttaatttcacttttggaatttttattgctcatagtaatacaattgatttttgtatactgacttagtatctcatcactttgctgaacttattagttctaatagttgtgtgtgtgtgtgtgtataaattccttaggattttctacatgatgatcatgtcattagcaaataaagacagttttacttttttacaatctacatgctttttaatttttttttttttttgagacagagtcttgctctgttgcccagcctggagtgcagtggcgtgatctcagctcactgcaagctccgcctcccgggttcatgccattctactgcctcagcctcccgagtagctgggactacaggcacccgccaccacacctggctaattttttgcatttttaatagagatgggttttcaccatgttagccaggatggtctcgatctcctgaccctgtgatccacccgccttggcctcccaaagtgctgggattacaggcgtgagccactgcgcccagcgatgatttttaatttttttgcttgattacactagaacctccagtacaatgttgaatagaagtggcaagagtgggtattcttgccttcttcctagtcttggaggcaaacatgcagtctttcatgattaggtatgatgtgagacagaattaggagaaatccagggggctctggaggatccagggatcagattggaggcagatagggcagaaacagttggaagggggtgggaatcaggtgtggctgtggagtaagctatttaagtccggattcagtctctgctagttcttatcactggacctgaatacaggagcacatctggattagaagatgtcagactcagaggatcttcccaaaggcaagcaccagatgcattcacgcaggaaatgaaccatgttcactgagaagctactggaagacttgaacatcttttttaatgagaacctatacccaaaccccagcctgcagtgggcttcgaaaattgacatacatccaacagtactggaggtctggttcgaaaaccacagagcaaaacttaagaaagcaaaatgcgagcatattcagcaaaaacaagaaactcaacaaccatcaataccagagggtgaagtcaagactagtgctggcctgagaaatacacacacggtactcagattccccaatgctgttcatcctgtcggcctggtgtatatgaatctttggacacccttgttccaactcattctgtaccccaaccttaaggtccctacaaatgacttccctggccaaaaaatagtccattttggctgctgccaagatcctaacatatactgcctctagcccgttttggaatcccaagtttgttctccaagcttcaattctagttcttctgcctgttctctctacgaagtcgagagagatgctaaatacaaaaaaaaatattgtaaaaacaaaacaaaacacttgtggtttttgtggatactctttatcaggttgaaggttgaagaagttcccttctaagtttgttgagaatttgtgttatgaatttgtatttttctgtgtctattgagatgatcacatggcttttgccctttattctattatgttcatttccacatgaatttcattttcctgaacttttacaagggaaatatagattttataactttatgactagagctctcctgttgtttttgtgaaatgtcaaaaaatatggtggcttaatttctgagatctccagactctgttcccctcccctactttttctggccctgttctttctttcgtctctattgtcactttagattgatcagcaagtctcctcagtgtggatctttatcctcaaaggatgctttggctggttagttctaagagcttatatgacccagactattttagatctcttatatcttattgcagaccattgctatggaggtttacccctacagttttagttcctgttctcactttggctctctgaactttcagtgagtaccttttggttattttgttgttcccaggtcagtgagatgccctgttgcttccctaagcatgtttctgtacagatgccaataccataggtattgtagctatcactggtccatccctacttgctcatatatatctttttactctccaaaacttattttttattactatacaaaatgtgcactctcctctctttttgtgtctcccaccccaccccccagagaacagtacatggtgtgcagggatggagtgaccaggaggcttttatcctgcaccctgcccacaggctaagctctgccccaggtcttttcaggcatttagatacacccgtagcctgtcaggctggggcaaaggtgtcccagctcacatgtactccttggcagagttggacttagagtaagagtgaggtacacagtacccagttttgctcttattcccagaacaagagcaagagaatagtacacctcctaggggggtcagagaagactctgcccagccaataaagatagcaggaccagactcatacctaatattcaaggggatcaaggggttgtaaaagtccgtgacaatctgatggccataccagaagaaagctaccaagtcagcaagacctgccatgatgaaaatgacacctctaatcatgcctatactgctataaagaaatacccaagactaggtaatttataaaggagagaggtttaattgactcacagtttagcatgactgtggaggcctcaggaaacttacaatcatggtggaaggggaagcaaagaccttcttcacatggcggcaggagacaggaagcatgtgagagagcaggaaaaactaccatttataaaaccatcagggccaggcacagtggcttatgcctgtaatcccagtactttgggaggctgaggtgggtggatcacctgagttcaggagttccagaccagcctggccaacatggtaaaaccccgtgtctactaaaaatacaaaaattagctgagtgtgatgggggatgcctgtaatcccagctacttgggaggcagaggcaggagaatcgcttgaacctgggagatggaggttgcagtgatctgagaccatgccattgcactccaacctgggcaacaagagcgaaactccatctcaaaaaacaaacaaacaaaaaaccatcagatcttgtgagaattcactcactatcatgagaagagtgtgggggaaactgcccccataatccagtcatttccctccctcaacatgtgaggattacaattcgagatgagatttgggtggggacacagagccaaaccatatgagctatacaggccttcttcactttgtcatttcccccacaacacatgcacttcatgcccatcgtggccacacacatatggtcaggaagcccagcaccaggtatgccaccattagggctcaaaggtcctgcatggctgctggcagggtgagcaccaagtcatacatttcacagctcatcaagcccatgctctgcatgatgtagtccatccacagtcccttgtacatggcctgggctgtgatgatgctgttgcccacacatgagctcatctgccactgcgggatggcggtgcaggccacaaggcccacccagcctagcagagccacggaaaagttcagcaactgcaggcccaaattggccatttccactctcagaaagaaactgggggtgctgggcaggcaaccctacagtaaaacaaataaaactttggggcatccccacgaaagacatcttggggtagagtttttaagtcatccaaagagacaaagaagtttttggctgggtgaccgcaaatcttgtcacccgaagtacacacaaattgacccctctggtgaagtgatagtctcacagcacagggaacaggcccatattttgtgttttgaggaaaacaatttattgtctagcttcgttgtacaaataactgttactttaaaagaaagctaacagctggataagttgaacatgaaaatgggaaaccaaagaacaaaagtgaggtatggcaacccctgggactatgataggagtgtgtcgggggagggggaatcacctttgttagatcacatctttgcaccaggtggcagaaataattgggaatggaaaggagtaaacaaacaacaacaacaacaacaacaacaaaggtgacacttcacctctattacttcaactactactttaacttactaatttgtgttttctaaatttaataaaaaattgcattacattagggaacctggaatcatattgcatgcaggtagttatgggtggggaagaaaggagattaatgaactgatgcactggtgttgcaagagatgtaatttgagtccttcaaagaaaatgcttgacgtttttatcatggtgagataatgagacctgttattatagtagattctctgttcaaggagggagaccttgagagtggattttactcacaactgccatcagtagacaaataaaataagtgaatgttcatgacctaagtacaagtgttactcaacaaaattaatgaagtccaacaaatttgaaaccagtaaaagtcatctagagggtctcagtggatactttttattttattttattttgagagggagtcttgctctgtcgcccagactggagttcagtggtacgatcttggctcactgcaacctccgcctcccaggttcaagcgattctcctgcctcagcctccggggtagctgggactacaggcatgtgccaccatgcctggctaatttttgtatttttagtacagacgggtttcactatgttggccaggctggtctcaaactcctgacctcaagtgagtcacctgcctcggcctcccaaagtgctgggattataggcgtgagccactatgcccggtcattgattttaaaaataaatattttaaaatctggcatgccatgtgattagaatcctcagtcactaaatcaggaaatttccattttaaaaagtaaaatgttggtcttttggatatttcaagccctcctccacacacactattcttatcccaagacttttatttcagccatcatgtaacatcttaaatttctccacaagtaactttatatttttgtcttaaaatcctcaaatgtttaaaatcatgcattttaaaccttttaaaagtcctagtactcttagtaatttaatggtgtccaaatgtggaagtgtaacttcaattcattagctgagaataactttttaaaaattacagcaactaaaacaataaggattaccagaaagcatttgtgttgattactgagcttccatgataaaaagcagtagatatacttctcaagtcattatattttatttaggacccacagaagcaaactcacatacttatcaaatattttaatgtaaatgcattagaaagcaaatcttaatttttatttatgtatgtatctatttagggacagggtctcactatgtttcccagcctggggcatagtggcacaaccatagctcactgcagcctggaactcctgggctcaatcaatcctcccaccccagtctcctgagtagctgggactacaggcacatcgcaccacacttagctaataaaaaaagaaaaaattagagatggggtctcactattttgcccaggctggtcttgaactcctggcctcaagtgatcctcctacctcagcctcctaagtagcagggaggggttacaggtatgagctactgttcccagctaaatcttaatttttgaatcaacttagtttcaaatatctttctgactatctgtaatattccaattaaatgccataatagctggttttgctttaaaatttggggaagactaattaaaagttttgataaggaaaattaaaaatacattgcagagtgatgatgtccaaataaattgaaaatcagacttaaaattaataggcaagtgcctcattaacaccatcaagcaattctgatatttgaggaacacagatgctagttccagaatcctcccctgcttctttctttatccttccaacttaatttgtacatgttgtcaacagagagagatttatagtaagcagagtttgatgaataaaattgtatgcctactaatatctgtatctaagaaatacttagcttattttatttaaatctattcaaaattgagataacactgaaaaggagattacagtgaaagatttgtttttctggatatcagcctgtctctcaaatttctagggtggagaaccggggaaggagaggaatgaaacaagaaaggaaacagatcacaaaggaattactgacaggagaaagaataatacatacctaagaacaaaacatacaaaacccaacattatcaaattctccagtctgaagaaggaggagcccacattcacaactcctataaacacattgaatgaggatctgacaatgttatattttattgtttagagttatacccattgatactgttcaaaggctgggattgaaggatgtggaagaaataacttgtcaaaaatatttgctggccaggcacagtgtcccatgcctgtaataccagcactttgggaggctgaggcgggtggatcaccttaaggtcaggagttggagaccagtctggccaacatggtgaaaccccgtctctactaaaaatataaaaattagccaggcgtgatggcatacgcctgtagtctcagctacttgggaggctgaggcaggagaatcgcttgaacgtgggaggtggagtttgccacaagccgaaattgcgccactacactccagcctgggagactatttcaaaaaaaaaacaaaaacaaaaacaaaacactacatgttgtcacttataactgggaactgaacaatgagaacacatggacactgggaggggaacaatactctgggggcctgtcaggggtgggttgtggggagggagagcattaggaaaaatagctaatgcatgctgagcttaatacctaggtgatgggttgataggtgcagcaaaccaccatggcacacatttatctatgtaacaaacctgcacatcctgtacatgtaccccggaacttaaaataaataagtaaataaataaataaaaagaaaaacaaaaacaaaatttgcccagtgaccagtatagtccttaaagcataatattcagccaacagctccctgttcaaacacaatcagagtaggcaacatgattcatttaaaatacttacttagcatctactatatgccagggatgattctaaatactgagactaaataaaataggtaaaaattcctgcctgcataagattatattctggtaggaaaagccaattgaaacaggatcaataagtaaagttatagaatacagatatagatataaaaagagctatgtcaataatgttaagtactaaagagaaaacaataaagccaggaagggaaataggatgtttgggcaggagtggcagtggtggtggtacggatattaatacaaaggtgacattaggtagtagctgaaggacgtgaggatattctggagaaagagcattccgggaagagtaaatgccaaaatcttgagacaggggcttgtccagtgtgttggatgaattacaagcaggccagttggctggagtgatgaggtcagacaggtacttgagggcagctcatgcccagcccattgcaaggtcttagaacttgactgtgagtgggctggagagacacgggaaggtttggaggagtatcatcatctgagttatgattttaacaggatcacccttactgctgtgatgagaacagaatgaatcaagagagggcgtttgtattagtctgttctcatgctgctaataaagacatacctgagactgggtaatttataaaggaaagagatttaattgactcacagttcagcatggctggggaggcctcagaaaacttacaatcatgtcagaaggggaagcaaaaacatccttcttcacatggtggcaggaaggagaagtgccgagcaaaagggggaaaagccccttataaaaccatcagaactcgtgagaactcactcgctatcacaaaaacagcatgagggtaaccatccccatgattcaattacctcccaccgggtccttcccaagacacgtggggattatgggaactacaattgaagatgaaatttgggtggggcacagccaaatcatattggcgtccttttaaggttagagatataatagcttctttgtgggtacactgatggaacagtccagtagagagggtaaaactgatgatgcgaaagagagacgggatatgtaataacttataacttatcagcaatttagcaaagacagctaaccagtaccttaggtgacatggtttggatgtttgtcccttccaaatctcatgttgaaatgtaatttccagtgttggaggtggggcctggtaggagatgattggatcatgggggtggatcccttatttacggtttagctctatccccttggtggtaagtgagttctcactcagttcatgtgagatctggtcatctaaaagtgtgtgacacctccccaccaccactcctgctcttgtcgtatgatgctgactctcccttcaccttctgccacaattgtaagctccctgaggccctcacccagagcagatcttggcaccatgttccttgaacaggctgcagaaccatgagccaattaaacctcttttctttataaattatccagcatcaggtatgtctttatagtgacacaaaaacagcctaatacattaggcaatccaaatgtatctaacatactatataatttacttatttatcatattcgttgttcattgtctatctgcccccactggaatgcaagctctatgaaggcagggacttctgtttttttcatttgcttatctatcccacgcacaggctgttacccagcacatagcaggtgctcaataaatttttgctgcacaaacatattttatgggcataaagagaaaaaacagtctgtcatataagtacaaccacttagtttggagtgtggagcagcacttggggatgatgaaaagagatggtgcctaaagaaatacagagagaaatgccaagctagccattggcaagccaccattccatggggacacagaaatacattgtctttttatccttcatgttttctgcttatttttgaaatccctttgtatccagagtaaaatgtagggaaggagcttcatcatctgtcacgtgtttacctgaagtatatgcttgataaatatagcagtttgaaaggctgcctagatggagggttctacactgtttttcacagagctcaccaggtcagtgattctggggttaggccatgtaaatctcctaaagcatccctattcctgaaatacacacacttatcactgagaatcactacaaaagatgaaatattttgaatatcttaaaggatatttttagggaagcattacatattcacttggccagacaacaaaagtcagttctctcgatgtttttatacaatatgctgagtattctctctgacagttaccaaggcctaagggaaagtaaagctgctgtgacacagtgacactcttatccggagcataaaataaatgtcagagtctctcctgtagtctgcaaaacttaagaaagggcatattctctataacacaagctataatttctaatgcttaaaaggtaccttatttgaaaataatacagattaaattgctatttcaaggctgaaactcacatattgctttgagcttaagtgaccattgctcagaaaataaactggacattattgtaagtgataaatacacttatctctttgttatagagaataacacttgcttttcctgtcctcaaagaaacggttgtcgtcatcgtaaccgaataagttacagctgagttcatcatcgcattcacacaagcctgccattttaaacaaggaagaattactgcagtaaacaactttataaatagaatggatagaagccatattttccatttattttatgaacttatttttttagaaatggggtatcactatgttgctcaggttggaatgcagtgggtattcacaggtctcatcatgccccactgcagcctcaaagtcctggcctcaagtgatcctcccacctcagcctccagagtagctgggactataggcacgcaccaccacatctggttagaagccatatcttttaaaagatttcttgatccttgaatcttagggaaaaggcaattttgatatctcttgtgacagagatgaactgatctgataggttactgggtttttctttctaattaacatacaatattattgacgtttttgtgtgcatacacttctgtgaattttaacacatttatacattcctgtaaccatgccacagtcagatacagaacaattacgtcactcattccccaccctgccaactcccttaaactctatcattgtcacaggagttggcaaactacacctgagtcaaatctggtccatagcctgttttcttagggcccagaagctaagaatcattttaacatttttaaagtgttgtaaaaagaacaaaaacaagagacaaaagtaaggaatatgtgacagagaccgtatgtggcccgcaaagcctaaactatttactatctggccctctacaggaaaagtttgctgtctcctgctttaggatcacaccttcccccaactactaatccttggaaatcactgacctgttttctgtcactgtagttttgtcttttcaaacatagcatatatattccatttataaatagaatcatagagtaggtagccttttgagttgttgttgtttttgagacggagtctcactctgtcgcccaggctggagtgcagtggcatgatctcggctcactacaacctccgcctccagggttcaagcgattcttgtccctcagcctcccaagtagctgggactactcttgttgcccaggccggagtgcaatggcatgatcttggctcaccgcaagctccacctcctgggttcaattgattctcctgcctcagcctcccgagtagctaggattacaggcatgtgccaccacgcccagctaaatttttttttttttttttttgagacgtagtctcactctgtcgcccaggctggagtgcagtggcgtgatctcggctcactgcaacctccgcctcctaggttgtagcagttctcctgcctcagcctcctgagtagctgggattacaggtgcgcaccaccacaccaggctaatttttttttttttttttgagatggagtctcactctgtcgcccaggctggagtgcagtggcgcgatcttggctcactgcaacctccgcctcctgggttgaagcagttttcctgactcagcctcctgtttagctgggattacaggcacgcaccaccacgcctggctaaatttttttttttttttttttttttttttagtagagacggagtttcaccatgttggtcaggctggtctcaaactcctgaccttgtgatccgcccgcctcggcctcccaaagtgctgggattacaggcataagcgtggtggtgcccagcaattgtttttatttttaaaacagacagggtttcaccatgttagccaggctggtcacgaactcctggcctcaagtaatctgccgacctcggcctcccaaagtgctgggattacaagcgtgagccaccgtgcctggcctccatttctattcttttgttactttgagaatattacataaacggaatcatatagtatgtgacattttgaggttggctttttttgacttagcatacagcagaatacccttgagaaccatccaaattgttgcatatattaatagttaattgctttttaactgctgagttatctgtggtatggatgtaccacagtatgtttagtcaactatagaggaacattttgattgtttcaaggttttggacattgcaaacaatattgctatgaccatctgtgtacaggtttgtatggacacaaatttttatttctctgggataaatacccaggagtgtgattgctgggttgtatttttagtttttgcccattttaaaaattgggctgtttgttttcttactgtttggttttgagggttcttcgtataccctggactggacatacaagttctttttttaaaaatggatcatacttttggtgttgggtctaagaaatctttgcctaaccactgatgatgatgattttctcccgtgcttcttcctaaaaggtttacagtcttatgttttacatttagatatggaatcaatttcaagttaatacactgttggtgggactgtaaactagttcaacccttatggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcacaagaacaaaaaaccaaacaccacatattctcactcataggtaggaattgaacaatgagaacacatggacacaggaaggggaacatcacactctggggactgttgtggggtggggggaggggggagggatagctttaggagatatacctaatgctaaatgaagagttgatgggtgcagcacaccagcatggcacatgtatacatatgtaactaacctgcatattgtgcacatgtaccctaaaacttaaagtataataataataaaagaaaaaaaaagaaaaaaatttcaagttaatttttggaaaagagatgaggtttaggcccaagttgactttttttgtatatggatatacaattattttaataccatttgttgaatagtctattctttctgcattgaattgccaatgtggtattaatattaatatatcatacaatggaatgttattaggcgttaaagaaggaatgaagtactcatacatgctacaacatggatgaaacttgaaaagattatgccaagtgaaagaaaccagttgcagaagatcacatactgtattgattccatttatataaaatgtcctgaataggcaaatctatagagacagaaagtagattagtgatcgcctagggcttgtggttttggagggtaaatgaggagtgactgctaattagtacagtttctttctgctgtgataaaaatgttctaaaattgtggtgatggttgtgaaacttttaatatactaaaagccatcaaattgtacactttaaatgggtgaaattgtatggcatgttaattatatttcaataaagccattataaatgtctgggggggaggaggggagaggaaagggtcttgctctgccactgaggctggagtgcagtggcacaatcatggctcactgcagccttgacctcctgggctcaatcaatcaaaactttttaaaaagaaggaagaatgtttatgcaatcaagcaatgacagagcacagcaacaagcaaaaattaggataactgagcaagaggtaaatagttttggacaattgtagagcaataatattagtaagaggtgctcagaaagcaatgtagtgggccaagcgcagcggctcacgcctgtaatcccagtactttgggaggccgaggcgggcagatcacctgaggtcaggagtttgagaccagcctggccaacatggtgaaatcccgtctctattaaaaatataaaaattagccgggcatggtggtgggagcctgtaatcccagctactcgggaggctgaggtgggagaatcacttgaaccttggaggcaaaggttgccatgagccgagatcgtgccactgcactctagcctgggtgacagagtgagactctgtctcaaaaaaaacaaaaacagaaacaaacaagcaaaaaaaaaaaaaatatagtgagtttatgaagtgttgaatgagctttgaacataaagttctttaaaatgacccaagcctattactcatacagcgctggtggcagtatacattgacgtaacatttatgcaaagcaatctgttaatttatatcaaaattaaaaaaaaacaaaaaacaaacctaagagtcttttgtaccattgagtgggggcagcagaagtctatgagattttcttctccttgccctagcattcattcactcctcttattcgatgtgtctgctgaactatccctcttctttggtctgaattttaacaattatgcattttaagtgtaagatgatgattgttttagacaattgggtgataaaaagaaaccagtaaagttaactttaaaagcaccagggaccggccgggcgtggtggctcacgcttgtaatcccagcactttgggaggccgaggcgggcggatcacaaggtcaggaaatcgagaccatcctggccaacacggtgaaaccccttctctactaaaaaaataaaaaataaattagccgcacacggtagcaggcgcctgaagtcccagctactcgggaggctgaggcaggagaatggcgcgaacccgggaggcagagcttgcagtgagccgagattgcgccactgcactccagcctgggcgacagagtgcccagagactccgtctcaaaaaaaaaaaaaaaaaaaagtaccagagaccaaatgagaggacaggtaagctaatataatgagtacctgaacttgtacttgcaaatgactaagtacttgtgaagctcttattttgttgagatcttctcttacagttatggatggccatatgactaagtgctacttaatgggatgtaagcagaagttttgggtggaggttctgggaaagctcttttaaaaggaggttgactcacctggcaagcgtcctgttgcctcttctcttttctctcttcctctttccttcagcctgaaatgcagacatgatggctggagttgcagtggtcatctggcaaccatgaggcaaactttagagtggaaaatgtgtgctaagaaggacaaagcagcgagacagaaggagcatgggacttggatgacttcatgggcttgacatgccactagtggattgcctacctctgcctgcaaaagacagaaaataatctcccaatttatttaagccactctttatttagtgtcgattgctagcagctgaacacaattcctaaagcattcactaacatccatgtggtggcatcatcttatcttcaatacccttcttcagatgatgctagtgtgaaccttacatggaatattttgaaccactgagttagggcattgtgtctcagtcaatctctccctccacttccaaacatagtgcctgataaatagtaggtgctcggttaaaatggattgaccattcatgagcctggctaagtcttgagccatgctaactctcacacaccaatcttcaatttggccaggctagctaaatcgaagactatagccattgtggttccttgaacacagtgaacaaactttacttcactttgaaggtagtagagtccaaaaccatcacaaaggtatttaataaagagccaatgaaaacatcagattaagacaactcagaaaaggcgatgatgatagagaagaaattattgctgttaaattaagtttagcctaaagctgccacctgatatattttaagttcagcctaacggcatctcctcacagagtgacctgtaacctaactggatgtgtaaacaaactataacctactctggtgccaaccaccgagttttggctaatcacaggcagcaaactgttcaaatcgtgtgtgtaaccaatctggctgtttctgtacctcgctttctttttgctgcctgtaaatcttcttcttccacacattcggagcaccggagactctctgaacctattctggcttcctgaactgtgaatagttctttgatcaattaaactctgttaaacttaatttgtctaaggtttttcttttaacaccacacaccaaaaagtaactatggaaggtaatggacatgtaaatttgtgtgactgtagtcatcatttcactatatgtatatgtatatcaaaacatgttgtacatcttaaatatacacaacaaaaaataaaagacgagattccagacctgcatttctttttctttcctaatccagctctctgtggtatattttgtgtctcttgttcatctctcctgtcctttagagtataaatgctcatctgcttcagcatttgtaaaactatcattttaaaataaagtgacctacataaataagtaattaccatggatgaataaataataaaggaaggagaagggagtacacacacatgctcatgagtcacacacataaagaaccagcagtggcattcggctgggtcaccaggatagaggaaaatcaccaggaaggagagaggagtcacgcagaatatgcctggggaagaggaaggttcacataaatattagaggaaggaagcattacaaaccagatcggaaattttgtctctgactttcaaaaatgcatttttaaatgcctggaggggctggcatctagctctcctttcagactgtgggaactgtgttatccctatgacagacctacagccaaggaaaataaaatgcagtcagcccttcagcaagaaatgtctggagaccatgtctataaggaagaagacatgaaacagtttaaactatagagcaatgaatttctcatacatcttttcttgcgacctaagatcaggagcttctgaccctaacgttatggaagagtgtttagctcctgatttgaagaatatgtggcatatgatagaatgttcagagacagcagggtcaactggcaggaataaggccgtgagaattcatagatttggacttcctgtccatattctacttctaactttgcccatttcaactttgcttcttacatttttggctcagcatcttttaagaaacttttatttttcacgtcattttctttatcctacttctttatattgaaaatttttaatcctgtagaaaagtgtaaaactagtacaatgaacacccacataccctttacctagatttgccaattattcacattttgtcaaatttgttttctctctatttaactgtatttctgtttttgtgtaaatgcatacttttttgtgaaagatccgagaggcttaaacataagtttcagacatcttgacattttacccatacatactgagaaagacattcctctacataactataatacatttatcacactcaggaaattaaacattgatactgtactgttataagcattccacattcctatttcttataataataagaacaataataactaataaaactaataacaatagtgtcctttatattgtttttcttaaatccagatccaattagaaatcatacattacagttagttgttacatctctttcctttcttttttttttttttttttttttttttgagacagagtcttgctctgtcgcctaggctggagtgcagtggcaccatctcggctcactgcaacctctgcctcctgggttcaagcagttctcccaagtagctgggattacaggcgtgtgccaccacacctggctaatttttatatttttagtagagatgggatttcaccatgttagccaggctggtctcaaactcctgacctcaggtgatctgcccgccttggcctcccaaagtgctgggattacagggtgagccaccacgcccggccctctttcctgtcttttaaaggttatccctgagcttttttttttttttttttttaccttttgtgacatcgacatttttgaatagtccaggtcagctgttttgcataatgttcctgaatttggtttgattatttcctaatgaatagaatctgttttgggaggagagggcaggaatatttaatgtgtgatctgtgtccttagtgcatcacatcagagggcacgtgatgtcaatttttcccattattggtgacattaaatttgatcatttggtttaagtggtgtccaccagacctctccattatagaggtaactttcccctttataaaattataactagtggtactttgagactgtgactatattattctctaacatttcacttaacgattttacatctattgatgattcttgcctgaatcaattattacaatggtgattgcacaatgttggttttttaattctaacaatcctgcattaattagttggccttcttctgtaaacaactttcccgtctcctcctccctacctcttaattttttaaagaatagggttggtttgaattctttatttaatgtgttatgatctgttccagtccttagttattttaatactcaaaactgtcccatatttagcaagtgagagtccttttaagctggcttctgccttctttctggcatgactttatcagttttgtttttgtacagtaagtcctcacttaaggccttcaatagattcttgaaaactgtgactttaagtgaaacaaagtattaaaaaacccatattccttccttatcagtgttataatgaaacaatgttattcaaggacctgctgtacaccatttcacttgaagttgcagtttccaagaatgtatcagtgaggttaagtgagtacttactgcacttccatattttgtgccacaagatattccaagttccctttatactttccccactccagcctagaatcgtctatttctccaagaagccctggttctgtatagtgggaaataatttctacagactaagatctgggcactagatatgctcattgctatcaaggtattatccacagatttttattttattttattttattttattttattttattttattttattttattttgagacggagttttgctcttgttgcccaggctggagtgctatggcatgatctcggctcactgcaacctctgcctcctgggatcaagcgattctcctgcctcagcctcccgagtagctgggattacaggcatgtgccaccacgcccgactaattttgtattttcagtagagatggggtttctccatgttggtcaggctggtctcgaactcccgatgtcaggtgatctgcctgcctcagcctcccaaagtgctgggattacaggcgtgagccaccccacctggcctatccacagatattttaaacagaaaagaaataccatcgagaacagtcatttcaggtgggctgtgtaaggctgaattagacaagaatgtataaagtataagaagaattttagaaggtaggtaatatttctgataatggttttcatttatgtaagatgacctaagtgcatgacacctggtaatgtcaaaattgacactcatattaaaaagccatattgaacatgccatgctctcatcagcatggtaatatgcattttccatatataatctagaatgtaatttgcatcatttaacataattttttttttttgagatgaagtcctgctctgttgcccaggctggagtgcaatagcacgatctcaacttgctgcaacctccccctcccaggttcaagcaattctcctgcctcagcctccccagtagctgggattacaggcgcatgccaccacgcgcagctaatttttgtatttttagtagagatggagtttcaccatgttgtccaagctggtcttgaacttctgacctcaggtgatccacctgccttggcctcccaaagtgctgggattacaggcgtgagctactgcacctggctcgatttaacatacattttaaccccacatttatttatagtgaaattttctgcctaggtttgaaaccttattcacacttacaactattttggggttttatttgagaagagggggagaaaagacgaatgaagaaagagaaaggaaacacaaggtgctttaattagagaaaaccactggatttctggtagttgaatctatcatctgaatgagtattgacataaagcataggtttataggtttataaagggatttccttaattctcagggaagctgtgtggcacaggctattaactatccaatactgcccactcctctagaactgagcaaagtagggatcttcataaattattttttaaatgattattgtatatgtaacccacataaagctgagctgtaccatggcccagtcataatatagtgctgttttcaaagaaaacagttcaatattcgagaaacaatttcaaaagtaatttaaattttaataaatcatcttaattttattttatttttggtaaaacattttttaaactccaaagggaggttctatttatattacatgggaaaacttttataactctttcccccaccatttctccctctcttcctatgcctaacttcaacatcttacgcacgtggcagaaatcctctgtccaaaaccctccatcctgtctccaaaactcatttagagctagctgttttctttttctccctcttttatcaccttccagatctcatttcttttcttctagtatcccctgccctttttaaaacagaggtttttttttttaagcagttttagattcagagcaaatgtaaagggaggtacaaatatttcccatactcccttcccccatacatgcacagactcccacattatcaacatcccccaccagagtggtatatttgctacaattgatgaacttacacttgacacatgattatcatgcacagatcagagtttaccttagagctgcctctaatgtatattctatgggtttggacaaatgtatagtgacatatattcacgtggaagtaactgatttgttttttattttataggctcatcggcagaagggatttgcctcttctcaaatgagacttcggacttggacttttgagttaatgctgaaatgagtgaagactctggggtactgttggggaggcatgattagttttgaaatgtgaaaaggacatgatatttgggaggggccagggtgaaatgatatggtttggttttgtccccacccaagtttcatcgtgaattttaatctgaattgtaatccccacgtattgaggaagggacctggtgtgacgtgattggatcacggggcggtttccctcatgatgttctcataatagtgagttcgcaagagatctggtcgtttgataagtgtctgctgcttcccccttcactttctctctctcctgccgccatataaaatgtgccttgcttccccttcgccttttgccatgattgtaattttcctgagacttccccagccatgcagaactgtgagtcaatgaaacctccttttatcataaattacccagtctctggtaatatctttatagcagtgtgaaaacggactaatataccatgtatttaaaggacttgagtgttatgatctaagtttttggtcactgcagccagcattacggggtaactcaagtccagtaacactgtggctcttgtagactcatagaggtgtcaccttgttgttcttggataagatccagaagaattccttgtattaccaggcaaagattcttgttctcttcccttattttttcccaaacaaatggagcctctctctctgtgctgagctgcctggaactgggagaggggtgacacaagcacccctgtggccactactattgggactgtgctgggtcagacccaaagccagaacagcactgggtctcaccgaaggcctgctgtaactactgcctatgtttgttcaaagacctagggttctacaatcagcagctggtggagccagccaggtttccgtccttctcttcagagtggcatgttcccaccagccctgggcaggtccagagatgctgtttgggagccagggcctggagccagaaaccttagaaatctacctggtgctctattctactgcagctgaggtggcatccaagccacaagacaaagtccttcccactcttccctccactttccacaagcagaggagtctctccctgtagccaccatcaccccagaaccatggcaggtactacctggctaaagccaatgttcactgaagggccaaggtctcttcagtcagtttgtggtgaatgctgccaagcctaggactctccctttaggtcagtgggctcccctctggcccagggcaggtccagaaatgctgtctaagagccaaggcctagaatcagggaccccaagagcccatttggtgctctggccaagctggtacctcaggtgtaagacaaagtcctctttactctttcctctctttttctcaagcagaagaagtctctccctgtagccaccacagctgagaatgtgctgggccatacctgaagccagcatgtctctgagtctcacccaaggtccacggcaagtactgccactgctaattatttagggcccaagggatttttagtcagcaagtgattaatcctgccaggactgggttcttctctgcaaggcagcaggttccattctggctcagcgtgtgtctagaaatgtcatccaggagctggggccttgaatggaggccccaggactctgcctcatggcctctcctactgtggctgaactggtatccaagtggcaataaatgtcctctttactcttccctgtcctttcttaagtaaaaggaagggatctctcccagagctgcaagctgtgcagcccggggttaggggaggggtggcacaagcatccccttggctactccggctggtgtctcactaggtcgcatgcctcccaagtgtactggctccaagcccagcacagcaccaacacttgcccaggaattgcagttcttgtggcctagactgcctttcaaatttatgtaggaccacagagcactttaacgcatggtggcgaggcttgaaagaactcagattctgactgccgagatgggtgattcccttctggctagggctgctctaaatgctccgtctgtgggcaccagctgagttctgcctggtgttgctttccactgtgacagggcagcactgagttccaatgcaaagtcccaccatcactgtgctctccttctcccaagcccacagattctttcttccacaccatgcagctgcttctgggggatggagaagaagtggtgtcagcaattcaagactgtctttcctaccctcttcagtgcctctttcagtgataagaagttaaagccaggtactgtgatcactcatctttttggttcttaggaaagtgctgttgtttgtggatagttgttcaatttggtgctcctacagggaagatgatcagtggagccttctattcagccatcttgctcctctgaaaagcgttttgaaaatgtcctatggaagcttgactttctggcactttccaaggaatgggttttccttcttatgaaaaagaaagattttattatatttgtgatcactgtttttaaacaagctctgtcaaatgtaactgtatctttctatggagatacccgcatgtttgtaatcagagagtataaataacaattgcaaatcccatctttatacttcagggtctccatggcaacatcacctcgtccccttgtagataggcagagccatgtgatttgttctggccaatgttctgtgaagggaggagtcattcctggactgaggtggtgaaaagttcacctgtgattctgtctcttcctctgctgggggactaaagaggctgcatgttccagacagtatagatacaaggtgttgaagcctctgacagcataggtacctgggtgactgaaacagacttttgttgtactgtatcaggccactaagattcagggcttgtttgctacctcattccttataatcagcctctccttgtttttcatatctattcactataagtaacattttaagctaaactatttaagtttagcttgggccctaaataatcagcagtggcagtacttgccgtggaccttgggtgagactcagagacatgctggcttcaggtatggcccagcacattctcagctgtggtggctacagggagagacttcttctgcttgagaaaaagagaggaaagtgtaaagaggactttgtcttacacctgaggtaccagcttggccagagcaccaaatgggctcttggggtccctgattctaggccttggctcttagacagcatttctgctgtctaactatatatgcatttatatgcatctaccaaaaatcaagtatatattatgtatattgctatggtttggctgtgtctccacccaaatctcatcttgaattgtagctcccataattcccacgtgtcatgggaaggacccagtgggaggtaattgaatcatgggggaggatctttcccatgctgttctcgtgatagtaagtctcatgagagcacatgctctctttgcctgctgccatggaagatgtgactttgcttctcctttgccttctgccatgattgtgaggcctccccagccatgtgaaactgtgagtcaattaaacctctttcctttatatattacccagtcttgggtatgtctttattagcagtgtgagaacagactaatacatgtatataatatataaattataaaagtaatatatcaagcatgtatatgttatatacatccactaaatatattaaatatatataatatattctccatacctcagctgtgacagctattatcagtttgattcatatgcttccaggctttttctatataaaggtatgaaagcattcaacatctaggtttcatatggcaactttgtcactaatgtcaagctttttacctttattaactaactccaaatccccaaaggagagttaaaagtttgttcttttaaatgttaaaatattaaagtttgtcttccacatttcgctcagagtgaaaactgccttatgtctccttcttcggcctcaaatagttctttcctcttggatgagttgttagagttgatcattgagagggcaagagagccttcaatctccctggctcttgacagcttcttccttttgctgcaaaggttgaagaaggaaaagaaagaaatttccaaagcacagtgtcccaagtatagctccagcaggaagaggcgtttttccaatgtactcttcttagtttccccacctcccaccatctcgttaaccttttcttttcttttcttttcttttttttgttttttttttttttgagacagagtctggctctgtcacccagggtggagtgcagtggtgcgatctccactcactgcaacctccgcctcccgagttcaaacgattctcccacctcagcctcctgagtaatcccgagctggcattacagacatgtgccaccatgcccggctaatttttctatttttagtagagatggggtttcaccatgttggccaggctggtctcaaactcctgacctcaggtgatctgatcacctcagcctcccaaagtgctggaattacagacatgagccactgcacccggcctcgttaaccttttcaactagactactatagtagataatattgcagtctcacaattaatcccttttaccagcccagagattactgtggacactccccatgcatactggtggcttcctgcatctctctgtgccttctggatgattaagcatgctgaaaatgtctgggaattaacaacctcgggaagaatactcaggacctccacttatgggggataagaataaataaatacataaatccgcacttaatgtcatcaacaggttcttagaaactgccactttaagcaagcaacatataacaaaaccaattttcccataggctaattgatataaacaagagttaagttcctgtagcatatttctggtcttcaaaacatgacaaaacttctaaataaagacccaaaacacttgtaatttagcaaagattaacaaaaaccagtaagataattatttacccaatttttggcacatcagtgagcgatgacagttgtggtggtagtgggttaaatcaaggaataaatgtttgcaaagcaaacattgtaaggagcatctcataccaccacgcagttcaaaaccaaacaatcataaagagagcaggctcactgagcgcttttttaccgcatcttttattgattgttgtggactttatgaatttttatttgacaataatttgtattcattcattcattcgttttccaacctgtttattctagttcagggtcacgggtggccagtgcctatcacagcagctcagggcgccaggtaggaacccaccctgaccaggaagccatctcatcatgggcggcactcacacacccatactcactcagactggggccatgtaggcaagtcagttgcacctcatgcgcacagctttgggatgtgggaggaaactggagtacctggaaaaaacccacacagactccacacagatcctggcctggccccagccaggaatcaattttattttttctcatcaaccttataacaaaacagcgttgaataaaacagtgttattggaggacttactgtaagccagcttctttgacccccagtggcacagttctgagatatcttgtactccctgtctcagaggactcctgccggaattgagcctcagttgcccaaagtaataacttgcccactgacacaccctttattagcttccctcctttccttgtctcacttcctcactctgtcactgtacttcctgggatcacctcctaaataaactacttgtttctaaaactttgtctcaagatctgctttcgggggagccgaaatgaagacagccataaggaaacttggttgactacaacactaccttatatctctaaaggccagaactcacaacttctgcctaggctggggtttctactttaccctgagatgtcaagatcagtcaggaagtatgttaaaaatactgaaatatgtgaatgatttccttcgtaagtatgagttagagtaaatccagttactctgtgaacagtgccattctgtctcactgagacaaggtgtgaacttatagctcgctaggaattggtcccacctgtgtcacccatcttctatgtttcagtggagaaattcctaggcaggttttttttttttttcttaaaaggtctgcattcagtcactcaacaagtattcattgtttattaagtgccaggcatgatgctaggtagtgggtatcacattataagtattaaaatttttatatgagtagttggtaactatgatacattaatttagaaactttagtgggatgtatatacttaattatgttctttaaatgtactaaaaaggaaatcgtgactgttaggcaaatactgtaaaatggctcacttaactcctattctaatgttggtggtatttcaggtgaaactttcccgtggggtgatggtgtatttttactaactacattttcctggctgcattatttctggctgagtcatatccaatctctttctgcttaaactagctagaatgaacctgttgtccataactatgaactttgagtaagagaactgtaaacaccagctgaggaaaaggttgcaaaagatacacacactggtctggggaacaggaatatggatgaacctataggagaggatacagagcgtggggacttttgtgtttcatattaatgaccaccagagagcatccacataggtgcacagcatgatccatcttgtgtatgtcagccaacctctttcctcggccaccctggttcctgtgaacagagtagtcatggtggcagtgatggaagctgtatatgggcccaacaacatgtactccctttcatcatggctgatctaactactgtctctgctaaatgcccaaccttccagcagtagacaccaaagctgagccctcaaaatggaccattgctctgggagatcagccagccaacagcatatgttgtcaaacttttgaatttttgccagtcttgtaagtgagaaacattatctctgtatcattttaattcgcatttctcttactgtaagtaaagttggatatcttttcacatatttaaaggctgttttcatttctttttctgtgaatggtctatacatatctcttacaactttttctatttcttttcttctcaatttaagaagttcattatatgttaaagatgcttacttcttgattgatataagttgcaaatatttttttccaattggtcatttgtcttctcacttttgtataatgttttctgacatgtaaaatgtttttatttttatgtgatcaaatttatctttttccttattgcttctggactttgaatcatagttaggaatgttttccctctcccagacttcaagggattcacccttattttctcttattatttgtgtagtttcatttttcacactgagaattcttctctatctggaatttaccagtgtaaggaataaattggatcttatctttttctgtatggctatcaagttgttccagtgccacttatttaaaaagtgtttcttgggctgggcgcagtggctcacacctgtaatcccagcactttgggaggccgaggcgggtggatcacctgatgtcaggagttcgagaccagcctagccaacatggtgaaaccctgtctctactaaaaatacaaaaaattagccaggcgtggtagcggacgcctgtaatcccagctactcgggagcctgaggcaggagaatcacttgaacctgggaggcagaggttgcagtgggccaagattgtgccactgcactccagcctgggcaacgagagtgaaactccgcctcaaaaaaaaagaaaaaaacaaaaaaaaccgtgtttcttttccccatgattgaaataagcttttatcatatactatatttccatgtgtgtgtggatgtatttcttgcttgctttatattctgttccatttgtcaattcatatgtcaatatcatagtgatttaattataaaacttttaaatatgttttcatatctcttggagctagccctcctcatcacttttatttcctaaggaatgtctgttcttacttgtttattcttctaaataaactttataatcaacatttctggctccagaaaataagactgatgaaattatattgagatagtgttaaatctgtagattagcttacaaagaattgacatttttatgttgttaaatttttctatcaaagaacgtggtaatctacttattcaaatattttaggagtgttttatagttttttcataaagattttccacatttcttgttatgtttctactaaggcactttattttattttgctcttgtaaatggtgttttctcttccattatttcttctaactggttattgattagaagaaatattgttaaaatgtccatactgcccaaagtgatctacaaattcaatgtaatccctatcaaaattctaacgacatttcttcacataaatttttaaaaaatcctaaaattcatatggaaccacaaaagaccctgaatagctaaagcaatcttgagcaaaaatagcaaagctagaggcatcatactagttgacttcaaaatatactacaaatctatagtaatcaaaactgcatggtactgacataaaaacaacacacatagatcaccagaacagaatatagggcccagaataaatccacacatttacagtcaatttatttgtcagtttttgacaaagatgccaagaacacacaatggagaatgaacagtctcttgattattatttgcagtaatttgttcattgactgttttaggttttccaggtatataataatatcagctgcaacaaaaaagataacattttacttctttctttctccttatgatgcctctacttgatttttttttctaattgctttggctaataccttcaatacaattcttaaaactagtggatccggaccaggcgcggtggctcacgcctctaattccagcactttaggaggccgaggagggcaaatcacttgaggtcaggagtttgagaccagcctgaccaacatggtgaaaccccatctctactaaaagtacaaaaattagctgggcatggtggtgtatgcctgtaatctcagctactcaggaggctgaggcacaagaatcgcttgaacccgggaggtggaggttgcagtgagctgagattgcactactgcacttagtctgggtgacagagtgagactccgtctcaaaacaaaacaaacaaacaaaaaactagtggatccaatgggccttcttatctcagtcctgactttggcatgaaaacctcccttatttgattattaagtaagatgctgtactttggggggaaatatataaatatataatcatgttaaagaaatatccatgaggtcctgttttatcatttttaacataagtgtcaactcctaaatttgtaagtggtaaaaaaatgagtcacattatttatctaaaagaaaatctgttaatgtaacacatgatcatagtaacttcacagacaagtgtgttcaagaatgtctattccaggaggtttataatcccaggggaggggtgccgcatgagccaatcacagaataattcaaaggctctaggatggagagtagggacagtatagtatagtgggtccctatattaaaaagactcaggttcgagttcgagtcctaactctgcaactgtgatcatgggcaagttactcagcctctcagggcctcaattgccttttatgtaaatgaggataatgatgctaagctacctgaaggattgctgtgtttagtgagataattgcccctgaagatttagtttaggacttggcacatactaaaagctcattaagtggtagctcttatcattaagtgctaaaacaagtagtaaagataataaatgctatgagggggtctctggaggaggggggcatttaagccaattctttgaaagctttgtagggtttgaatagacagaggattgaggaggaaaaagaggactttctaggtaggaggggaaagatctttaaaatgtaaacggtcatgccaaaacagtagttcattttaatttgtgtttttttaaagttccaattgctttttttgtccagctgccttttaaaagcatcattatttaaaatcaagctgggcatagtggctcacacttgtaatcccagcactttgggaggccaagactggcagatcacttgaagccagaagttcgagaccagcctcgtcaacatggcaaaaccccgtctctactaaaaatacaaaaattagcaaggtgtggtggcgcatgcctgtaatcccaactactcgggaggctgaggcacaagaatcgcttgaacccaggagttggaggtggcagtgagccgagtttgtgccactgcactctagcctaggtgacagagtgaaactctgtctcaaaaataaataaataaataaataaataaataaataaataaagcatcattatttaaaatttgatttgctgtcattacattttgcagaatacttgaatatgaatagcatgttttattacgcatatgagagaaaaacattttgaatcaacttccatgctgcctatctttaaggcccccattggcttcctcatcccttataatttttgtctagctgctactttgcattttaatttgaccctgccttttatttatttgcacttattaccagagtgctttcttaaattaaaattttttgtgtgtttcctattcagtatttgatgactgtttattactgtaattcattgttcagaaaaatgtaccacatcccacatccatcattatactccattctccatggggtctaaaccattttacggagtcattaaatgaatatattatttgggaattaaatgaatggaaagaaagggaaagggtatccaaaggtggtgaggaggtgagggaggcagtggtgggacttattcaaagcacaccctccactgcaagcaggaagtacataaaaagcctgagcctttccctttcccctacctccccactctgcccactagtcctctaatttagtggaaacttgcattaatctctttttcagactgagattgggagtgtgcagggtggttgaacaaaaatttgtgaaacatgttggttgtctcaggttttgttatccaagaagactgatatggtttggctatgtccccttccaaatctcaacttgaattgtagctcccataatccccatgtatcataggagggacccagtgggaggtaattgaatcatggtggtggtgggttttcccatgctgttctcatgacaatgaataagtctcatgagatctgatggtttaataaagggcagttcccctgcacaagctctcttgcctgctgccatgtaagatgtgcctttcctcctcctttgtcttctgccatgattgtgaggcctccccagacatttggaactgtgagtccattaaacctctttttctttataaattaccccgtctcgggtatttcttcattgcagtatgaaaatggactaatacaaagaccctgaatcaagaatttgaatgccaatagttcatttgagaggtgaacctcaaaaacaacagtggggaaagggggaagtaaaaaaggaaggagaaggaagccatgttaaggagaaggaaggtatgttattgtccagaactataaagggtcatgtattcatttaaaatttgaaaaagaataaatgcttactggagaaattccagaaaagatatatatgtatacagattatatggatgtatattattatatgatataaatgtcaagaagtgtgaaggttctgagattttaccgtacttgcaagctaacaagttagccagccacagattcatagatgctggcagaagacaggagactcctggtttagaggaaagggatatattactcatggcacagcaggcagttccccacatttccacagggtgatggggaatggcccatatggatgctgcacatgcagtattaatcaccaaattcccatcccttttcgactagggctgctccggggaccttaactccatggcacttctggtctattgaccattctaccacacccagttgtcagagccagtcctgaccaaaatatggaattggctttgattaccaacttccccttctccaaactttccccaaggtgactgtctctaccttccccaaggagaaagtgggtccacatctttatgtgtcttggtctcttcttttattctcag

SEQ ID NO: 881 - DNA, 54690 bp, mus musculus; identical to SEQ ID NO: 880

SEQ ID NO: 882 - DNA, 592 bp, mus musculus
gaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccct

SEQ ID NO: 883 - DNA, 592 bp, mus musculus; identical to SEQ ID NO: 882

SEQ ID NO: 884 - DNA, 379214 bp, mus musculus
gaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccacatgttgaatgtatagatttcagctttaactaccaacttgattataatagacaaggagagggtgacatataaataaagccgtttcttatggcatctggccatttggtttggatccagtacaaaactgtggtttaatcagtgattaaaaatttaagtaaaaagttaactgatagtttccacaaatggtttggtacgtctagcaagaatctgccacttttaagaagtatgctttcgagaaaaaaaaaaacacttatctctgttagtagtaacaccttgattatattcttctcttccctttagccatttgtcctgattcatcttttatgttttacttgctttgacaaggtaactagatagttatgagatcgtatcattttcagttcctagctaacttcactgttccggttcctagctaacttcactgttccgtgttgaacatagcttgatacggtagaacaagatttgaatccaagagtttgttaatattaacatgaattttctttttttgctcaaacataacttttgagccttacgtgattttacaagcagatgtgtcagagttaacaaaaacaaatttaggaagacattgtggcacattttaaggcaagcaagttgaccaaacagtaagatttagtaagcttttcaggaaagaattcatctgggattcttagaagtttgctagtaagatacaactttacttagatgaaatttttttattttgagtattatgttaataatctctgaactagtccttaatttgtgtgtgtatatgagtgtaaaggagttgtggtatgggattataaaagagagccatatggtgatagaaattatttgtgtaggtgatcttggggcataggggttcttaaactcctgaaattgtatgaaaatatttgagtgtatatgggtacatttatttttctgggccccatggctttcatcagtttttcaaaggcatccattacctatagaagagtaagaactatggcattacaaaagatagaaagtaaaggaaagaatagttgattccactctaagttactgagtagggaagaaggggaaatggcattgaccacacaggtgattgatattgaaacgaattcttctagtggtaaaaaagaagttaactactcaatgtctacatagattaaaatttccgctacagaggaaaattaattcagtcgctccagtataatggattcataaggtataaggcttgtgtagtttggttgttttcatttagttcctcagaattctggaaaaatggaaatggaacacatattttcttttctttttttttttttgggacgaagtctcgctctgttgccatggctggagtccagtggcgcgatcttggctcactgcaacctctgcctcccgggttcaagtgattctcctgcctcagcctcctgagtagctgggattacaggcacgtgccaccacacccagctaatttttgtatttttagtagagacgggatttcaccatgttggtcagcctggaaagcagattttctatagagaggaactgctttcatttatatcctcaactttttaatgagtattagtgagaaatttttcagagtggcatttcaacactataatgatttctatttaagattacttaaataaaaatttaatggaattcacttcagtttttttcatataagcatcctcataatgacccttttgttttgattcttttaaaataaggcattcctgtcttggactcatcacattttgaataatgcattagtagtagagttttggattttatgtaactattttggttaggcccagattgcaacatgtcatcaaacagcatgaatcttagattaatttgtaatttgatgtcaaccatggaatgcattttgttaaattgagtagaagagaaagctctataaatgttgtgaaggaactacatcttgaatcctacttatttaaggcagtgacttaaccattaagagaggccaatgttgatgcagaacaccgcaccccacaccacacggtagtgtagagtgacctaacagtatttgatgtttttgcatttttgactttgtgttcctgcataatttctgaagcctttggttcttcaaacagtaaagtcaaattagttaatttttctggttattatgtaacttcctatttggttatttgtttacaactggataaattatgtttttatttatttatttattttgagacggagtctcgctctgttgcccaggctggagtgcagtggtgtgatctcggcccactgcaacctctgcctcctgggtgcaagcgattctcctgcctcagcctccctagcagctgggattacaggtgtgcaccaccaggcccagctaatcttttttgtatttttgtagagacggggtttcaccatattggccaggctggtcttgaattcttgacctcaagtgatccacccacctccacctcccaaagtgctaggattacaggcttgagccactgcacccagtcttgatttttaatgataaggtatgagcaacaatgatttcatttatgcaatacaggtttactgagtacctactgtgtgctaggcataattctaagggttggtgatacaaagatacttgtagtctactgagacagacagggaagttaattaatgcttaaaatgcaatgtgagccagacgtggtagcttgtgcctataatcccagctacacaggctgctaaggcaggaggatttcttgagctcaggagtttgaagctgcagtgagctgtgactataccactgtattacagccttggcgacagagaacccatctctttaaggaaaaaaaaaaaagcagtgtgataagttgctataggaatatgcatggttgggggtggtcatggagaggcatctacgtagaattgcatgcttgagtaagaaaaggcttatcgcagtaggtgacatttgcagctgaaggctgaagaaaataggtgagggaaaggcattctaggttgaaaaaacaacatatacaaaggtaaacagataagggagcatatccaataaagaaagttcacttagatgaatatggctgaaacaaagggtacacatggtagacttgctagaaaagagacggggtccggatcatgatggatcttgtatgccatgttagagtttcaacttctttctgaaagtaggggtaacccattaaagagattaaggcggagaatgacctgatcagatttgggtttcagaaaaaaaagtactttggagaatttcttggaaaagcatgctagaatggaggcaggaagaccatttagaaggagcagagtagcataaaagagtttttgatatttggagacctggattccagttgcagcttatccattcattcatttaccagctcatccatttactaggtgtttttctctgcacctcagtttccttctgccacctcccttgcctctccttagtaccacacaccctgaacatccccaccaaatctgaaatggccacccctttctcttttataactttcaccccctttcacagcccagctcatgtctcaatattctctcactcttccattaaacaccgattacttcagtttagtgagggctttccttcttctggactcaataactgtcatgagtctgaatgttacatgctgatcttgtctctgcaaatattttaaactgcctctgggaatgggtcccattttatgtctattcttgaaaacctggcaggccggtgcttgggtgcaaaactattcagtaaataattattagctggggatttttttcccctatataccaggtattttgagagtgtaaattggtgaaaagaggctttttaaaaaaatgtttatttgtatgtgccttttttttttttaaagtatatgtactccatcaattgaacctatccatacattcctctttgtcttttctccaattttgaaactcagtaaacttcttcagggctgtgagaactcttctacccccagcttgtttgaattcttgtgatgtcagagcctaaacttccaagcatggaaacagtaccaacaacgatgagccaagtaacattttactcttattagcaggagacttcatattattggcaaaagaatatggaacggagagccaaaagacctgggttccagtgtcccatctgtcttttatttgcttgtgatttctgatgagccatttagcaccagaagtttgagctctttgattaatgtttgccagttggggataatgctgcctgcctgatttgcttcacaaggtgttttagataaaatacagtaaggaatgagaaagcattaggaaattctatattgttatacaaatatagagcatttttattaaccccttatattacttgaatcaaatatgattatggttggatggtttaatgtctttcttgcattttgacagcactaatgttattattgtataaagtaccataatatggttatatgttgaaagattccttattctctccccaataccatttgtccctttggaggaatatgcattctatccttttactaagatttcattctgttgaatgaatataagatgtgagtctaatttttttccatgataattttttggaggactagtctacccttttctttcattgtgtcaatttgaggcattaaaatttttttaaacaaaacttccatttgatatctgtgacattatgccttgtcaggcagcttactgcctttgtacaaataaagaaactgagtcactgaaatgttaagaggactgctttagagataagtttaaaagctacctcctctattgtagaaattatccgtagcactgagtcattgtgcttcagggactctgaaggtgaaaaagttattcaatttttcttcttttgttcctttttggaacaattctaattgtaatccacctagatattattaagctctggcagtagcaacatgttactgaagtgaaatcatgttcttttccaacctgctttcaaagaacactgtaaataacagcatacataatatatgctaatttatataaatcagcacatctggttaaatgttactgggtaccactagcactacaggggttattgttgaagacccaactccagtctaccatgcagaagaaaccggttccttctgctggatttggggtgtttgatacatttttttcccctcaagacaggagaaactatgatgatgtccaggtaacttaaaatatagttattagcttgatatccaagtgggcatgttgtggaagacacccattgtgggatacagctcaaaactgatgcatttaaagaaagattaagatatattttcacatagctatttattgtgaatgtcagtaatggagagaaattaactcatactgatttaaaacttattttcctcatcaggttgagtctgtttccaaataatatactctggctgtagcttaaacagacaactgaattctggtatttaactgactttgtgtgaggttacctggcagggaaaggtattggtccctttctcatgaaagaatgtagaaaacaaaattcttacttatcaccatttgcacagtctttggtttactgaagattttactgtattgctttaaggagagtaagctacattgctacaaatacataccagcatattggccaccagctgtatacagtgtggcctatgaatgagtgagaagcttctaggtagctattaaggcaggcctaggtaggaatccaacactttattaggaaggaattattccgaaatggctgttgactcaatcacctggcagttctggcactcacccaagggagaagagattttgggtacaatcctttttaaaaaatctatttgttgttctgtgatatcatagacatccaggctttaaaaagaaagatctgctcaaaattaagaggaattttaacctacccttaattcgttggtctgttattaagctaaaagtaaaagaaataaacttttaaacttcataatatgagccagttaatgagacttttttacaaaacttaaacaaattttcaaacgtgctaaaaagtagaatagtacaatgaaccaccaccatctatccattgcccagatataagttatctacattttgcaacatttgcttgatccatcctttatttttcccttgctaaagtattttagtgcaaatctcagatatcttgtcattttactcctacatactgtcacgtctttaaaaattaaaattaacatattccttggtatcatccagcattcattccataatcaaatattaccaattgcctaaaaaaattagatttttgatctaaggtgtacctaattgatatacatgtcactgaactccttaaacaaatacagctttaaattactggtaaaatcttattcagagttactccacataaagtgctatcataaagcctcagcccaaattaagttcacttctgtctttaattctgtagaagtatctggaaaggttgactatacaagggtggatagactccttggaacagctgttatgtaccatcaaaaatagaacaaattagttttggctttactcactggttgggcaatcactaattcttcattttgcaatttgtgaagtggggtggggcttatgtgtaagaattttcctttcagggaaatgctgtagatagttaggcaaaggaaaattattcttcatttctctagataaagcgttcatatgactctttgacattcacaccccaccacaacaactaagtttatgttactggctctagttttatttcaaaacaaatgccggtttggtctatctttgtttttcagcccctttgatatagtctaggttgctgaatctggataattgggtgagtaaacctttacatagaagttattcttattgagatgtttgtgggcttacaattgaaaatcagactacactaatgaggtgatggagctggggatgggtggagtaggtaaatatgagaaatcaacttgggcaaatggcctagactccacacagatttgctaaagaaattgtgtaactattactttccagacagcagtttagtgctgttattgtgctgagaggcaataggcaaataatttcactagctgtagactcaagtagatttaggctagtaatctgtctccactctgcaacttctagactgaccatttactaacccagtcagttgggtagttttcctcaaaacagatagatgagtgataattgttggagccagagagctggcattttcttcttttgtttggcccgggagggaaaactatggaggtggtgttttatgtgctctgaaatcaatcactgataaagtcttaaatgcttagtagtctattgtgctggctgaaactgtttacaaagattctatatgtagataggaagaccttgtataggctgtacacttgcattgtgagctttaataatgtatacgtataacagagaccaggtcggtatgtatgggtgggccctgaccaagggtgtgagaccacagaggtcacaccacttaccaaatcatgtgccagttacaagactatgtcttcctggggctgcgttttctgattcacacagaggcaccatatgggctagctaatacatttaaagccagatggattttagtctcatacctgataagaaattcagcaaggattccgggcatggtggctcacgcctgtagtcccaggactttgggaggctgaggcgggtggatcacctgaggtcagaagtttgagaccagcctggccaacatggtgaaaccccatctctactaaaaatacaaaaattagctgtgcatgatgggagacgcctgtaatcccagctactcgggaggctgaggcagaagaattgcttgaacccagaaggcagaggttgcagtgagccaagattgcaccattgtactctagcatgggcaacaagagtgaaacttcattttgagtagggatttcttatttgtcattggttctgagaaaagaatgtaagatgtatatttatgtaatatcctacacctgattacttttgcttttgaattattgaaatcttcaaatgtagatggctgtgcccttgagggcctaggttatagttcagtatgttcattatcttccccaacttaagggttgagttctgttatagctaattgtagatcaattagcttaaggctcctccctttctgcactcctttcagcaattttcttgacataattgtttcacagagttttatatggttacgcattatctaggctgcattttttttttttttagatggagtctcactctgtcacccaggctggagtgcagtggcctgatctctgcttactgcaacctccgcctcccgggttcaagcgattcttctgcctcagcctcccgagtacctgggattacaagcatgcaccaccacgcccagctaatttttgtatttttagtagagatggggtttcccaatgtttcccaggctagtctcaaactcctgacctcaagtgatccgccctcctgggcctcccaaagtgctgggattacaggcatgagctaccgcgcctggctgcattgttttttgaagtttgtaccatgcttatttccactttcattgctcacgatacagggcagaacatatagaaagttaagatgggttaaaacaaatttggcagaagcatttcctctgataatatgctctgcaatctagtacctcacattacaaaatcaacgtttttcagaagagtcagtgtgtacataaaatatttgtgagtgaaaataaacttcttagggtgccctcagcttgtttttcattgacattgcattagtttacattatctacctccccacccccactttggttgactagctaatggtcttttttttttttttttttgagacagagtctcgctctgtcgcccgggctgaagcacagtggcatgatttcggctcactgcaacctccacttcttgggttcaaaagattctcctgcctcagcctcctgagtagctggtatcacaggtgtacatcaccccacccggctaattttttgtgtgtttttagtagagacagggttttgccattttggccaggctggtcctgaactcctggcctcaagtgatatgcctgcctcggcctcccaaagtgctggagttacaggtatgagccacaacgcctggcgctaatggtctttaaacaagctgttacagggaagaataagtttatgattcaaaaatggcctggattttatccatgctggcagtttagattttcacgtgtttgttttacgaaagtagggcttccctgtattctcttatctcaaattcttaggcttcttcattacagcctatacttgcttcatcaaactgcattcagatggtcttgtaagttcccatgagagcaaaatcctacattttaatataagctgagttggtctgggacaaaatactagattttaaatggccattatctctgtataaaatggagctgaggtattagttgcactttacagtaggaactgtgtagggctctgggcccaatttttcacattcttcctatgggttctgttatagctaattgtagatcaagatatgttacaaatccctactttcaacctcctctctcctccttaaataatgttactacttgcatgtttataactctgaagggcatcttatttcttgttgtttttactgatttctgtgactattatcaatggtgtatcctattgtctgaccacggagataacaggcagaaggatggccattggatgttaaatcgattactgaacatgacagagatttattttaaagcatttcctatcctcactcatcaccacgtagttatgaactagtcaaaacttcattttgatcttagcaccaccacttcatgtttttcaagatgcctacattgtattttatggaatctaaatgtatttaatatgctatacagagttgaaataagctaaataggatatttgatcctattaagtgttttttaggagtttgtttctggttatttaaaaaggttgggctgggtgcagtggctgatgcctataatcctagcactttgggaggccaaggcaggaggattgcttgagcccaggaggttgaggctgcagtgagctgtgatcgtaccactgcattccagcctgggtgacagagtgagaccctgactctaaaagaaaagaaaaattttaaaaaaagatcctgtagagataagccgactactttttaaaaatgtgactctggacaagtcttttatttttcttctctctgggtgtcagtgtattctgtaaaataagggaatcgaaatagatgatctacaaagttccatttagctctggcatactgggagtcaaagtttattgaaagctgtaatacatctaccctaacataaatacaagacctctggattccagttagacaaaaagttggaattaggctgaatgctaaagagtgaatatcccagttaactttattgtcctgtttctggagtctaggttagcctagtctagtgaaggccacatcaacgtttctttttaactatgaattgtacggaaggtaatggtctgagccctagggaatgctggcttcctctgcgtcatcctgattcttgggaggatgctttggttcagtgaccaagtacagtatgcaagccttcccagagatgattctcaatagtacacaatatcataggtaccagtttttgttctaagtgctttgcgtgtatttgttaagaactgtgcaaggtctgggattttcccttacttacctacctgttaactgtttaatggatgattgcagaagacccaaaggacaaaagacagtttattattcattgcaaaagcagtagccagaatgtcagcatgacatgctggttcactatgaccataagtcccatcgtgggtagaccagcatgatggccacaaacggagtcagtgacattgcaggagaggaactctgagcttgggggtttgctacttttatagcattaagaagtcagcttgatctttggggtggggagatatcacctcatcctcaaggttgtttgctacaaacacagccatgggaaatggccccagtaaaatgctgtcagtgccttttagtcttggcatagccagcaagaatgggcaggggatgctcagggattcatggcagattgcctccttcatcagttttaactaatttcatcctcacagcaatcattttgtaggtgaagaaaacgtctccaagcagatgagtaactggcccgaggacatgcaaaggtgaatttagaattgaagaccaatgtggggccagatgtggtggctcacacctgtaatcccagcactttgggcggccgaggcaggtggatcaccagaggtcaggagttcaagaccagcctggccaacatggtggaaccctgtctctactgaaaatacaaaaattagccaggcatggtggcatgtacctgtaatcccagctacctgggaggccgaggcaggagaattgcttgatcccgggaggcagaggttgcagtgagccgagatccgccactgcacttcagcctgggcaacagagcgagactctgtctcaaaaaaataaaatatttttaaaaataaaatagaattcaagaccaatgtgactgtaaaatgtatgttttacaccacgattttctatactgcctgagaacctcaaggtagctctaaattgaagacctagtggttctctagactggtgatggtgggacctagcctagatttgcactctgcttatgtataatttagaagacagagttcaggggccattcgttttagtgccattgtcaaaaaaaaaaaaattctttgaatcactgccatgaagtaatgggtcagaaatgtgaccactaagaaaaagccaagaggacaaaagtgatatggctgtggattttaaggctacttgaacacagttcttaaaaataccagcctgtgatagcccaccactggggaaaaaaaaaatacctgtctagcagtctggcctttattaactaattgcatggccagcagaaggcctgtgtactttactactgttgcatattgcatatgattttcttgttgtttgtacgtcagccttgcagagactagcttctgaagaggttacattgcaagttatactgcctacttcatgttttagcttctctctctcctctattgcccacttcctttctgtttgtgatcttttgcatgaagtaaaagtgctttggaaaaattaatgctatctcctgttaaacaagtacacgatatgcattgtttcttgtttaggggagtgccaagaaccacctaccctctcctgctgcttcctgcgtgtgctttgcctaaagattggctgctataaaagtgtggtatattcagccaagtgctatctttttaattagtttgcagaaagtgttgtgacaaactatttttgtgttgacttgtgacgagtaatagacccctaaactacgggcgttaagtgccagacaatatggaagtgcataatgtagtttgagttctagtccccttagtttgatccatcatccttccccaaagaaaaagcccctaatttttaaaaatgtgacaggtaaaatagattacgaatataccagtatgtgtctggagcctgaaattggcctatttcttataattactaatcttaaacttttttttttttttttttaagagatgaggtcttgctctgttgcccagactggaatgcagtggcatgatcatagctcactgcaaactcaaactcctgggttcaggttatcctcctcccttagcatcccaagtagctggtactacaggcatgtgccaccatgccccactaaattttttttttttttcagtagagacagcattttgctgtgttgcccaggctggtctggaactcctggcctcaagtgatcctcctgcctcaactcagcctctcacttggattataggaatgagccaccacacctggcttgattaccaatgttaatgagctaatatttccatattggttctgttcatacaactgtgtacaacacagcatgaaactagaaagtgaaggatatcttaagctctcataatgatagagacataactgggaaagctgataattaagcagactaagaatcttagtaaatttttgtttttcaaatacttcttatcaatttttacaaattcatattttctctaaatatagtcctggttgttgatgttcttttgtttttcactccatctaacccaaagggcttcgtgttacggataaatatgtaaggaaggatatagcattcccatgtcccaaaaactgtgttgttctttttatttagaccagtgattttcagtgggggctaattttacctcccagggaacatttggtaatgtctggagacatttttggttctcacaactgggggagggtgctacactggcatctagtgaatagaggcctgggttgctgttctctatcctacaatcataggacattctctccagcacaaagaattattcagtctaaaatgtcaaggttaagaaactctgctttagaccctataacattttgtatatttagtgtgaaaaactttttgtatatttagtgtgaaaaatttctgtggctcctcagctgttctttactttccattctctcctttcctctctattcagacagggtcagctaatccctgtcttcatggaagcatggtttgtttcattgattcccgccaattttatttgcattttcttcttttctgctactggaaatctggtggactgcactgttgtgaactttttagttgtcaactataccttttatcacttacctcatttctgacatctaaggaaaatattcattttcatcgtagtgagtttaaaaggctctttttccatctgtggattctttgatacttcaacaacttttgatgctggtgacttttaactcatcatctatatgaattttatttatttatatatcattttgagacagggtctccctctactgcccaggctagagtgcagtggcgcaatcatggctcactgcagcctcgacctccctggctcaagccatcctcccacctcagcctcctgagtagctgggactacaggcacatgccatcatgctcagctaatttttgtatttttcatagagatgtggtttcgccatgttgcccaggctggtcttgaacccctgggttcaagcgatccacccgtctcagcctcccaaagtgattacaggcctgagccatgcatctggcctgaattttagattctatggtacagtcttctctgacaacttctgcctcttgatttgctgactgctaaagtgccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttctactaaaaactgcataacacctcaaatacttcatagtggtgtttttaatatttttcctttttacaggaaaaataaaaattaacttgatgctctcaacacacatacatacacatacacagacacacatggacacacacacactgtttatcaggtttaccttttcaagctaaggtttacttgcttcacttatcaccagactgtattattctgttgttagtcactgactgacctttatgatttctggtccagttgaatgaaggttaacttccctatttgaccagtgaaagtcagtgactccttctcattcaactcatcaggtcccactgtatttttacatttagggctactattaggcacctaattgtatcttcttccttttttaatttgctccccttttaaaagttgaagccgttaggtgtattgtctcatatgcctgaaataacctcttcttttttctgttctcagtgaatcctaagtactttctttctagttctttatataactcttaaaccctttattgcctacttgaaggtgacatgatcatttcattccccttcaatttcccatagagagccagttcatttctgcagcatgcatggccatattaacaattgtccttattataaatgtatgttatagtgttcattccagacacatcaaatctttgttatgtatggggcatcatgctgagggtataaacataagtatatacaggtcttactcttgaggagctcatggcctaatgagaaaaggacagatacatataaagtagtaaattctataataaataggtatgaggagaacgctcttgggaatgccgcatactgtgcttggtagggagaggaaagacttcacagaggtaacatttgatttgggtcttagggatgaagaacagctttgtaagattaaaaggcaagtttttttttttaagactagtcgagtgcagtagtgagaagtggggaaagagtagaacaaggagttagatctgtaactgactgtgaacaatcattcgagataacttactaccttcagaccagccaaggcaagccattcttaatagtgggattatcatgtatgcaagtttagagttatgtaaaggcacatatttgttttaagtgtcattgattttaaaatattaagatcttagagagaaggttgtgactgaacttgttttatgactgaacgtaggtgatcataggaaatatttttcaccaactcagaagtgggatagagagagggaactaacgtttagtgagcacctacagtatttcaggtgttgttctaggagctttacatcaccatcttaattttttattataaacacgtaggcatagttatttcccacatttaacaaatatgggaaacgagtctcagagaggttaattgattctgattccaaaatacatgatattttatgatagcattctgtcttcttcttacaagtaacaggctatatttaaaatctagaaatgagctgtaattttctattttttacataaatatgttttatttttctcctatcgcagatcctattaggagtctaataaatgtattttaacacatttcctttttgttggattacattagttgagaaataatagagcttgagaaattggctgggaattgtccacaaacatctaatttgtagctgtatctggttagttttattactgatgatttgggcaagctcctcagttggtaatattctacctctgaaattcttcatgttcaatagttaatctaatttaataaatgttttggagaagctcacctcagtgctgcggtaagcattatcagggttaaagtaaagaactcctacccactagaaacatagagttggagaatctgatgtatacaaacctgtggtgctgggtggaatgtgataagtgctactgtagaaggaaaaagtgctatgggagcacaaatcgtgttaattccaaatgaagtattagggatgacttcatggaaagataggcaatagaagagagtcttaaagtgcagagattttttttaaaacagttattgtgatagaatggagaaagggcattgtctgtagtgagaaaaatatgcatatctcagtcagcacaggctgctatagcaaattcccatagactaggtggcatatgaacaacagaaatttattacacacagttgtggagactggaagtccaagatcagggtaccagcttgatagagttctggtaagggccctcttccgagttgcaaactgctgacttcttgtggtatcctcacatggtggagaatggagagcgaaagcaaactctcttgtgagttttacagagtcactaatcccattcatgaaggttctaccttcatgacctcatctaatccttattacctcccagagacctcacctcctactaccatcacatggggtgggggttcagtttcacggtatacattttagggggaaacagacattcagtccatgacaacgcataactgcaagagagctaggaagttagggcatgtttgaggaaaaatatgagttagtctagtaaagcccagatgtatgtatgagagtggtggaggtcagtctggatggagagactgcagcttgattacataagcattcagtgctcaccataaacaatttggaattcattctataacccatgtagagtatttgagcaggagattgatgtgatcagagcttacaatcatatcttactttagacattttacagttggaaatatgaagtctaaaatcttatgtccaaactttctggtaattggcctgtttgtagtataaatataaagatatttattaattctgataccttttggcatgctttaatttgacagctttgaacttgcaaaattaaacatgtactgtaaatagtgtgtactttgataacttactgttttacagcaacttaattggcccttgctcccagcctactattctgtagatctgtgcctctaagtctaaagatcttgttgttgtttttttcctccacaaatagatcctactctaaaggtcaggtagcttagattacaaggctgctgctgtcaaactgaatgtgttgggtctaggctgaattacagtcttatagtccctggaatattccaagagaagctgcaagatttatgacatacaaaactaggtaaagttatcctcactagataaagttgtcctcaatcaagtgttatcatgaattttttttccgtttgcatatatcaatcccctatgacaaaatgagaagagatacattgcttacaactgtggcaaagtagtcttagggctatgatttgaactcaagtcccctacttaagataattcacttaaataagtggaatttttattaagagactccctccctccttttcttttcttttctgttttgagacagggtcttgctctgtcatcaggctggaatgcaatgttgtgatcatggcttactgctgcctcggactgttgggctcaagggatccccccaccttagcctcctgagcagctaggactacaggcatgtgtcaccatgcctggctttttttatgcagtgggttgtagctatagaaagaggacattatttcacaaggtataggctgggaaaatgttcaggttccttgtggggttacaaaattattttaaaaagatataggtctttaggacatgaatcatcttttggtagactactttctcatgagggatttgtgatcctggcaaaatcccttttgagcctttgaaacatgaagagcattaactacaaatgaagaagacaggaacttcctgagttataaatacctggccatatgaaaggcccttgggcaggggctcccctggtatgttgagtcaaaatattgcctggcctttttctcccccttgctactgatgttgccttgggaatttgagacccagtcacatcagagtactctttgtttatttctttctcagtgaccttcataaatgtgatagtgctgggaacaatcttctgaagcatctctcttacttgccctaccatatgatttttttgccaaaaaggttggggctgataggagcttttactctgctactggtctctcctccatttttgcttagtagtgtggagcacattttcccatgaacattattcctgtatttgatatgtattgtagtatagttcagtttcctaatatgtttagtgcttaaagatataggtcatgagatacaggtacttgttatcaaggaatttacaatattataaggaaaacagctgtatataacctcagtattcggtaagttccatatgaatgattcagatttaggaacaggaaagattaataatttggattaaaatagactaggaactgagtcactgggaacttctcttcctccctccacgtacttactccaagggaagaatgcattcagagttcaaaacagagggttttttttttttttttttttgaggtggagtcttgctctgttgcccaggctggagtgcagtggtgcgatcttggttcactacaacctccacctcccaggtacaagcaattctcctgcctcagcctcttgagtagctgggattacaggcacatgccactacgcccggctaatttttgtatttttagtcgagacagggtttcaccatgttggtcaggctggtcttgaactgacctcatgatccgcccgcctcggccttccaaagtgctgggattacaggcgtgagccactgtgcctggccaaaaccgagttttgaggctgcagtgagctatgatcgtgccactgcattccagcctgggctacatagtgagacctcaactctaaaaaataaaaattaaaagaaaaaagaagtttgtggcataggtatttcttgttttaagaaaatatatcagcaggaaatttgaattaaggaagcagacaattaatgggcaatgattgcttttacaagagttaatacagggttaccgcagccaactcctttcttcttttaaaatgttttatatgccaaaaataaatactacttttaaaataattttttaaataaacaaaatgtttatgatttttttagaagaccaccttatattttaatgctaattataaccatctccacactattgatctgaaatgtgcagtacattgaaaaacgtaaaagtattttcaatgcattagaaacatagtttccattttcccaagcttctcattccccttaatcctgtagattccctttctcacagattaaagtagcattagaatcacttgcctcaaggccactgggaaagcttgcaaaaaatatagatacaggagtcccaatggacctattgaaacagaatcctttgagtgcaggccctgggaatctgcattaataagctgcctgcatgattttgtactctaaagttggagaaccactaaacttgtgcacagtttgcaaaatggcagccctgcaagtcatacctggcccatagatttgtttggtttggctttcagtattagcaatgtggtttttaaaatttgatttgtttgctaactcttaagaattgggagtttgtacacataaatctaaattcctggcttctcttgaaacatcagagtaatttttacagtactaggctcatgttctcacatggctggcagcaatccactgtgtctgaataagatctgtcttatttgaataggccatgtgctcttgaattggccacagaccaccctcctgcatttcacctggggtccagtgttaattgacatttatttttctatagctggcctgcatcactcaattatatcccctgcttagaatccatatacatttgagtttttgactctggatctagaggttaagaactacacagaaactatgggaaagaagtgagactggaagctgggagaccagagagattataatagtggagataagaaatgaaccatggaactacggcagtggtactagggatggagaagaggaggaagattaggatttagaagctactaattgagttgggttggggatctggatgggagaaggaagaatgagtgtggtggagttgggagagatgaaagtaggtgggaagatgaatttgtttctggatacagtcacttgaggtgatcgtgggacatcattgcgaggtactgaagtatagcttgctatggagcagagactctacagtgttggagaggatgactcctggatggagcatatgacagactcctgggtgtatgtgtagactgagaaagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacacagaatctttgggtggaggtatatccaaatctctggaggataggagattcttatccaaattgtcaaagattattaaaggttgacacattgcaggtgggcacggtgactcaagcctgtaatcccagcactttgggaggctgaggcaggcagatcacttgaggtcaggggtttgagaccagcctggccaacatgatgaaaccctgtctctactttttgattgattgattgatggattgattgactgatggattgattgatttagagacagagtctcgctcagttgcccaggctggagtgcagtggcgtgatctcggctcactgcaacctctgcctccggggctcaagcgattctcatgcctcagtctcccaagtagctgggattacaggtgtccgccaccatgcccagctaacgtttttgtatttttagtagagacggggtttcaccatgttggccaggccggtcttgaactcctggtctcaggtgatctacctgcctcggcctcccaaagtgctgggattataggtgtgagccaccatgcctggccttagtaattttaatttttagtacaaaaattaacctgatatggtggcatatgcctgtaatcccagctactctggaggttgaggcaggagaatcacttgaacctgggaggtggaggttgcagtgagccaagatcacgccattgcactccagcctgggagacagagtgagactctgtctcaaaaaaataaataagtaaaagaatacatatgtactcgtctcaaaagaaaaaaaaatgcttggcacattgctgtagggtatcaccaagacacaatgatttaatgacaaccacttctttcttgcaagtggtaattttggtttctttctccctttatctcttctgcattttaaattttgctctgtgagtattctttagttctgcggatgctaggagcatgctgtattctaaaaagtgtttgcaaggcatttttctttttttatatctccaagaaaatgtttctttgggaacatgttatgaatggaggttaggttcccagggtagctcatctttttcaaatcccacttaatctacattgcagatgagctgttctattaatagcatgtgtctgagctctgggagcagacatgtgccatgtggtatagaaacattgaagaaagtctcttcctcttttctgaccataggctaaatttggaaactggtaaattttatctttgggatgctccaaatccctttctgtacctcttttccatataattgtacccctcccctcaggtgacacccatcctcctgtgactcttccccaccccccacccagatcattttttttttttttttgaggtggagtctgctctgttgccaggctggagtgcagtggcgtgatcttggctcactgcaacctccgcctcccgggttcaagcaattctctgcctcagcctcccaaatagctgggattacaggcgcctgccaccgcgcctggctaatttttgtatttttagtagagatagggtttcaccatcttggccaggctggtcttgaactcctgaccttgtgatccacctgcctcagtctcccaaagtgctgggattagaggcgtgagccaccgtgcccgtcccccaccccctgcgacatctttcccattcctcagtgtacctacctcttcccaaacttgatttctgtcacatctctgctgagtgttagaatgaactaagttatgcaattatttttgaatgtactttattgtgatttaaaaaatgattattaacatccattaattgcttggtgaaatatctgtcaagtagcacaataaagtgaataaagcctggcagtgcagtagaatgttctggggaggtaggtaatcatataagcagtcttgctttgaggttctcccctagggataattgtttctacttttcaagtcttgccttcattcacatataagcctatttttcagaagttctcttttttcatgactgcctctatgagagcagcagagaggcttccggggttgagggtaggcaaatagggcaagaagagtggctgtatgggatgggacttccgtaagtctaggactgcccatatggccttttgaatgaagggaatattccataatggcttattttaagcagtaattaacaaatgaaaaaaatttcatatttcttcccataaatggtaacatgtaatttgtaagcttagacaatttgatcactgaggtaaatgatgaatatcattaaaagcattggttcctaataatttgtaaagtacttcgtttctgtttgttaatttgcttaccaaatctgtctatcagtcacttgcatttgttcccaaacctatatatgccagtggtaattgctattgtaactatattatttaattaaacatgcaatttgatgaaatgtgtgaggcaaaagaaatctttctatgaaaattgagaagtcttttgcataaattgataaaggcgctaaaaggattgctactgaattaagcataggtgaggtaactgaaagcctaggaaaaaaataacaagtccaaaaggattcatatggctttgcaggtgtctccagtttctatcttctaaagaaaatgaaactacatatagtagagaatgcattaagggatggtttatgaaaggaagatgctctgatgtagctctacatcaaaatattgataaatgtgtattttgatgtcataaattaaaatgttgaaggtaatgtttgcttttaatgattcctccattaccaactttaaaaaaattaaccacacactggaccttatcatgtctgtataatactttacagtaaaagctcgttttccatgctatgaaatgacgttctagttaacatttcccttctttgccatttctaggtgtagtgaaggaccagcataccttcgaatcaaagtttgttgaatgatcatcgtagtcaaacagattttattctaattatttagaatttactaatcacaaattgttgctttgttataacattctttccatgacagataaaggcatttattgaatatggtaattttattttgtgaacatgataaagtagggaatgatttcagtatatagtgactgagtccttgccattaaagattttttcaagtacggtacttatccagggacatactttctggaacatttgtggttcctcttaggtaatcttgaggaattctatatatttgtaccttgacattatcttagtactcctgctgtttttagtaggatttttgtttgggaggttgctaagtattatttagaagtgaaatctgataaggggattctaaaacctttctcctaccacaatagttcttttcaaatgcagataaactgtcattcagtgagactacctaggctcagccttcagggtaggatgaataaagcaatatatttgctggattgactttttgtccaggctgtatcgaaaaaataatgtacttagccactgaccatttatgtctttttaatgattgtatgtatagtagtcaaatggttagaatttatatgcagaaggatataccatatcacattttcattgtaaattgctgctttactctcctgtctgccacattctttctggtgattctatatttgtgttgattgcttttcatggataataaagaaatttacatttttctctttttactttgtgtggattaatgctctagatttgaatgcctaatgctagtcaatctttggatcacatatgtaatactcctccataatagcacccccctccactcccaccatatgatgaggagggaaaattttttctaaatattttatttttatttcagtagttttgggggaacggggggtttttggttacatggataagttctttagtggtgatttctgagattttggtgcacttgtcacctgagcagtttacactgtacccaatgtgtagtcttttatccctcaccctccctcctgaaaattcattgcatcattctcatacctttgcatcctcatagcttagcacccacttatgagtgagaataaatgatgtttggttttacattgctgagttacttcacttagaataattgtctccaacactccactcaggttgctgcaaatgccattatttcattcctttttatggctgagtagtattccatgttgtatacataacacatttgctttatccacttgctggctgatgggcatttaggctggtttcatatttttgcagttgctaattgttctgctataaacatgcatgtgcaagtgtccttttcatataatgacttcttttcctttgggtagtgggattgctggattaaatggtagatctacttttagttctttaaggaatctccatactgttttccatagtggttgtactagtttacattcccaccagcagtatgtgaaagtgttcccttttcaccacatccatgccaacatctattattttttgatttttagattatggccattcttgcaggagtaaggtggtatcgcattgtgggtttaatttgcacttccttgataattagtgatgttgagcattttttcatgtttgttggccatttgcatatcttcttttgagaattgtctatttatgtcctttgcccactttttgatgggattatttgtttttttcttgctgatttgagttccttgtagatgctggatgtcctttgtcagatgcatgggaggaaaattaacaactggttagagtaatagttttagaatttgtgtatatagattgctggtacaaaatgattgaatgcctatgtgttatcctggctgtatagtgaatcaaatgggtaaactattagagatagtatatgaggtaaagacaacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctgaaaatgaagagaccttttaacctggtgggtcaagtttgacttaagttcttgaacaaattcactgtaagtactctagaggcagtgtttatgagggaatttagatgccaggataatttttttaaatagaaggaataaattgccccttgtttcccaattaagacacctaagaagcttgatctgtaatcatgtcttctgtggttactctctgaagtcttatgttgaaataagtggctgtctctcttctgtccctttatgtaccatcactggtatagccagtcctgcctatagaaaggaaaaatcaagttttttacacctcgtgttagaatgggtattttctacagaaactgtttcaaaggagaatggagttggaatactacttactaccagtgtgactctgaaggtgtattatagatttttataggattttaataaggttttttaaagctgatttgcgaattcaaccatcattgagaactttgtttctgtaagaaaatgtagtcgcagaactaactccatatgtttcatcagggctacgaagggcccatgtatgtagaaaacttcagtagtattgattatggctactaaataggtaattttgttgaaaataagtttaacattattagcaaatagaatggtaattgaagagaagttaatttaggaattttgtaaaaaacttggctatgattatggtactgacacagtaatgtggggccagaacttatggtaaccccataagagtgattctataatttttttttttttttttttttttttgagactgagtctcattctgttgcccgggctggagtgcagtggtgcgatctcggctcactgcaaccactgcctcctgggtttaagtgattctcctgcctcggcctcccaagtagcttggattacaggcgcccaccaccacgcatggctaatttttttgtatttttagcagagacggggtttcactatgttggtcaggctggtcttgaactcctgacctcaagtgatccgcccgcctccgccttccaaagtgtcgggattacaggcgtgagccaccacgcttggctaattctataaatttttaagcgtatctttatttgtttttcagtgatctactgactgtaaatcattctgtcagcttcatagtaacatttaatttcaacctacccagtccctaattggccaaactgttataaaaccaaattacgcagcagtgaggaaaatagaaacttgaatgaatgctattaaaataagtttagaccatctcaaatttatcctcataattcagactttctctgttttcaaagaagacgtctcatacacactgagtgttattggcagatttgacatggctggagtcttatgtgcagaaatataatatgtatctgtcagtggttttcaggagcccctatgaaagggcttgattttgctggtttgaagcctttgttggcatcagcaaagtcaaagagttgtaggcaaggttaacagccacttcatatttaatgggtttatgcaaaccgtgatctatatattgattatataaaatacatcactgttgtcttaacatccagatgaaaaggaaaaaaatgttttctacatcaaaatctttagacttaaaaatctctgtgattcataatattaattaaaagagaaaataaaaatctgaataatttgctttgacctgtgtatgtataagggtcattataagggttagtgcttgggttgcttgtgagttttcaggcaaagggacatacagctcatcttttttatattgcaactgatcagtgattaatacttaagaggcttcaggggctaagtatagttgctgatttatttgcagctcttactccacttcaattatttaaatacagcgaagagtccgtcgtgagaaacacaacagagtaggagaaatttgagatctatcagcataaacagatacaagtgttgctttgccccaaatcataaaaagtaaaaaaattaaaactacctgttaattcattgtgatattatttgtaaaacacagtgacataaatgatattttcctacaatgtgttatttattattttgacaatttctgtcactatgttgagaaagaatctcttatccaaattaaaactaagtaaaaaactatttaaggaacattatgagacaaaaggttttttcagttatcactactcagcatagaatctgaagcccattgggggaaaaatgaagtttataaaattgagtaatttataatattaaatttttccaaaaacactttttaaattttctgaaaattattttttgttcaccatataatcacattctgtttaagcttctacgttttaaatatttgatataatatttagtgatttttaaagttcttcctgtgtgagtaaatgagctgtttttgttttccatgtagagaagtttgtctgctttcactctggaaatgatttcttatgggttaacgcctttggatacatgtgttccaagagctaaacaactgctatacaagtgaattttgagacatggcccattcctgaattggggattgtttgcaaattcaagaccatcagttaaaagtactaatagtgaagttaacttaaatcactgtatgacttttatgtattttttcctacaaaaaatataataataccttattcacaactcaggtataattttcagtttttggcaatttatactcttgaatttttaaagcagtgaatcattttgttttgtcagattaattttgcaactacatcagaaaactaaatgatgtggttatttgtaaaagctgcttgaagtagacagatagcaagtcattgtgaggtgaagtatctccagagtgataatcatagccatttagaggttatttttgcattataaagatagtaatcataacaacagatatttaaattactctatttaatacaaacagcaatcatatgtctgggtacattgcttcaataacaagcgttattttaaacaaaattatatatactaactgccttatctatttatattgctcccatcctaggctaagcttttatcatcttgcaactggatcacattctctctctgtcgctctcttcctctgtctctctcctcccccagccccaattctgtcaatcatcacaggtttgagtacttactatgtgctagaaatagtgcaaaaacctgaggacacagtgggaatcgagaaaaacctggtccttactacattgagtttacagtattgcacagaagactgatattgataggtaattaggatttgatacgtggaatgtgttgcagaaggaaccatgggagactataacaggatcaactgtatccttagctgagagcagaacagttgagtagaagatggctagatgattaagaaagaggtgaggtgggatggagcgggtgctgtaagcagagcaaagagcacctggaaaggccgagactgaaaaagagctggagctctaaccagtattgttatactgatgaagactgttgcacacagatttcagaatatagatagatgttctagagtgtgtgttctagtcagacctgaatgctaatctggactgtgtaatttattatctttgtgatttaggcaaatgacttaatgactgtaaaccttgatttcctgatgagtaaaacaagacagtaccttcttgtacataggattattgtgaggatttaaacaaggcaatgcctgtaaagctcttagcatagtgcctataaatgctcagtaaatggtagctattagttaggtagaatagaccaaacttgctgatctctgcaagccgcctttttagcctttgattccttctttagtttattctcaatattacaggtccataacccttttctgaaattctgaaatatgaatgctctgaaaacactcttatcatttggccacaagccccaaccttcttaaggccgtataggtactctttatttatcctgttttgtgaaatatccatgttttccttttaaacttgaatacatttgagttaatgtgttaccccagatcctgcttagtgtgttttgtaagatatgatacacctagcatattcctttctaaaacatgaaacatgctgagttccaagacgtgtttggcttgaaaggtttcaaataaaagattgtacacgtgtgccaacccaaagtcagctttctaaaataccattttctccatgtctgtcttcaaatcagaaaatcataagaacgcctagtggttttccagtttagttttgactattccttgtggttttcaagactgcctctaatccaccctacatattcaaaatttaatacccttgtacttgaaccatttgtttcataagtctgttctcttcaacttccctgaagtaaaatgttaatgctgctccttttgtctgacttccctctctttctctctttgtggctcttcagatccctacccaacaattaggccacaattctttgtagtttctcaatgaagctatatttatctatttcttctctgaattcttattgtgcttaaatgaatttatttaacagtatttgagcagatattatgtgccagctactgttctaagtgtcagagatctgaaagtgaataagacagttaaggtctctactgttagggaacttgttttctagaaagtagaagacaacctgtaatcccagcactttgggaggctgaggtggatggatcacgaggtcagaagttcgagaccagcctggccaagatgatgaaacctgatctctactaaaaatacaaaaattagccgggcatgatggcgggcacctgtatccaagctactcgggaggctgaggcagggaattgcttgaatccgggaggtggaggttgcagtgagccgagatcgtgccactgcactccagcctgggtgacagagggagactccgtctcaaaaaaaaaaaaagaaaaaaaaaagtagaacacaaataagtgaacaatatcatttcagataacagttaatgctgtcaagataagacaggaggatagtgccttgggagaagcgacatacctgagaaactcatagtttcgcatttagttatttttgtttttatatggttagttttttttttttggtttgacggagtcccactctctcgcccaggctggaatgtaatggcatgatctcggttcactgcaacctctgccttccaggttcaagcaattctcctgcctcagtctcccaagtagctgggattacaggtgcccaccactacacccagctaatttttgtatttttagtagagacgggggtttcaccatgttggtcaggctggtctcgaattcctgacctgaggtgacccacccgccttggcctcccaaagtgctggtagtacaggtgtgagccaccaagcccagcctatatggttagtttttactccctggttagactgtaaatgccttaagggaagaatccttaaacttctatgtgccataaagtgttgggtataaaatgggtgcttgattaaggtttggttgagaaatttgtccttttttgacagagaaggtaaaaatctatttattaaatataaagcactacttggctaaatcattgatctaagagtatctgttatgtacaaagtactgtgttggttttgaaatttttgtatttgtctaaatctagctttttcatttctattgctttttattcatagtctaagaaagaagaactttcatgtctacacaacttttttttcccatttgaaatgctttaatattgtgaaccccataaatttgagacaggtctcagtttagaaagtttattttgccaaggttgacaatgcgcttgtgacacagcctcaggaagtcctgatgacatgtgcccaaggtggtcagtgcacagcttgcttttatacatgttagggagacatgagacatcaatcaatatgtaagaagtacattagttccatccagaaatgtggagacaactcaaagtaaggcctccctactgggggcttccaggtcacaggtaggtgagagtcagatggttacattcttttgagtttctggtaagtcttttcaaaagaggcaatcagaatatgcatttgtctctgtgagcagagggatgactttgaatagaataagaggcggttcccagcttgaagaggcccaagatattttcctttcacagtataaagcaaacaaacattctttctatacctgtagaggatgctactactctaaaagctggattattcctgcaattgtttctgcttaattcaggcactaagtgacttcctccaattcattagtgtgaacattcttaaagacctaagtggcagacatatttcctgaaccatttacccttagtcctgaagctgatcaggtttgtcacacacagactgctatagtcacccctcctggcagttcaagattgagctttatggcaagacaattcatttaagattgagcataacttgttatgacagatttatcaaaattatccagtgaagtaacatagacttctgctttgtgaagaaaactgaaaccctatactgtgatgtcatatttgttctcttatagataaatattttgttctttataaattgaaagagcatcttgagaagagaatctcaaaaggatttttttcttgtcataaaaatggtggaatgaattttgatttgtaatagcaaagaactctggtgggttaaaatttgaggcttttgaattgactgtacttctgagatggtgtgcttatggtcacaaaaatacaaaagtattgctctactaaaatgatgaaatggacagttcaagatgttaacaatggcaaagtaaggtggagaactggaacttcatatctgtaacttcatcttctcaactactaggcttttgagctttgagggcagggccatatctctctaaatccccagtgcctcacacaccaccacttgatctagcatctattcttaagtgctaatggtgatagaggactacagtgcctaagatgaagtgtaggtggctgaaaatgactcttacttttagaaaggagatgaaagaatgattgggagtaattttaagtacacgcagtaaatagttcagtgattgcaaaaggaaaaatttgttttctaaaaggtcatcttagactcaagcctgtactttgagcttagttctaaaaataaaattagacattgctttcttggtgaaattaaacacaactgagaggtactcaactaacagaaaatctttataataaagcatttgaatgcctgaacagaatgttcagcttggttaccaggtgattggccttgagttgtttggattggccttactggtttttaaagttcaggagtgagtatagggtctgaaaagttggaaggcaggcctttgaatagtaactacttccctctgtgactgctgcttatctgaatagggattgggcagggatgtcgtccagagaaatcaaaccctgaatcattggttgatgttgattacctttctcaaggtccattctgacttggaaaatatatggagattataatagagtattaccatatcagaactctcagaagctttatattgtgattgttctttcattcttctgatcttcaactagagtgtaacctccttaaaggaagacagcatgcttaccttgtttaccactgtattcccagtgcccagtactgaacagtttcacttatgtcactcgtgtccatgtgaagagaccaccaaacaggctttgtgtgagcaacaaggctgtttatttcacctgggcgcaggcgggctgagtccgaaaagagagtcagtgaagggaggtaggggtggggccgttttataggatttgggtaggtaaaggaaaactacagtcaaagggggttctctggcgggcaggagtgggagtcacaaggtgctcagtgggggaactttttgagccaggatgagccaggagaaggaatttcacaaggtaatgtcatcagttaaggcaaggaccagccattttcacttcttttgtggtggaatgtcatcagttaaggcaggaacaggccattttcacttcttttgtgattcttcagttacttcgggccatcggggtgtataggtgcaggtcacaggggatgctatggcttagcttgggtccagaggcctgacaaacagatgcatagtagatgcttaaatatttgttcagctgaagtgaaggttgttttttgtgtcctattgtacctgccattcttggaacgcaagaaacttaaggaaggtaaagagttgacccttcatctctattgtaatggccaacttaattcattttctttaagagagaagaaaatagtcaaatagtgcgaatacgtttttgagttggtggtgagacttttgaattatatgcaacttagttgtccaatttctgtggtagtagagtaattgcacgatgtttataaaacattgtattaccatgtaacattagctataagagagttgaatctttacatcttgctctttttgttaatttctgcctgattgagaaaattaaaacttaattttcttacaataatgactcttgcattgcaatcacaacttcagcattagagtttataagtaagtcagtcatttctcttagtcttaaggggttgagactctggagtgatacttttatagttacacaatattcatataatactgtgctaagttatatttaatatagctgatcataaatgaagtttaataaactctgattgcttgactaatgcacagtcttattgcttttccagagttgattttaatgaaaatatatggtcactatatttattggtacaatatgccctcattgtaatgagcatgatcattagatttgcataataaaaacttacaaaaatgactttaatcagtgcttttaattcaggggtatgactctaataaagatttttgggggggtcatttttgtttctgactttttttaactccatagtagctctgtagtttgtacacaggaatgaaatccatgtttacttgcatgtggtgtgagacagatgcacccatccacataaatgaattttgagagcttgtcccagaagaccatcattataaatgaaaaaaatttttttggtgtttctgttgttattctcaagtccttttatacctttcttttttgactaatatagaaagataattgtgtagcagaaatgatttcgttttgtttgcagatcatttaattgtaacttatacaatgatttcaatgcatgtttaatgtacagtggctaaaaattaccccttctgaaattcagcccttcatatctgcttaaagattttccttttcgatagaccatatttgttcttttttctgaacagttataacgaagagctttaaatagtattatatttatgaaagcagatttttacatgagggaaatctgagaaaatattcgtattaaatgtatgtggttatacaggatatccactctagttgaatgaaatttacaaatcaagaaatcaggagtggggtgtttttctttatgtttctctatcacacgtaattaggataattttttacataagtataatttcctatgtgccttcgggtactctatcattcttgtagatgcctgtcaggaaaaaagaaaattctttaagaataaaacaaagcacagtccttctccagtattatttttgaccaggggtccacatttggtttatcaacaactaaactttcaattcaagggcagctctagaattagaaatgtatatagcagaatggacattccaaatcaaagggaacagtaggggcacaaagaggacatcatgggagtatgcattgggaagaggattttaatttttgttttctgtagaatagggatcataagagaagaagtagaagatagcccagggctgaatcatacagggctttgaattccatattaaggatattcatctttattctataggtcatcaggaggcattgaatatttatgaacaggagggagtatgatagtcattcatactctttattgagcctcaatgtgccaaacactgctttaggcgttagggttacatccctaaaccagatgggcaaaaatccctgtccttgtggagcttatattttttgttggaaaaacagaccaagataatgataattaagtaaattatagactatgttagaacgtgctaaatcttgttcaggagtgccaggaatatgtggagggaggcagatgtttccatttgaaataggatggccagggtaggcctcactgagcaaaaccttgaaagcaggaagagggagtaagccatatgggccatggagaaagagcattccaggcagagagaagagccagtgcatgtggcttattgcctcattggggagccgtgaagtggtcagtgtgactggagctgggggaatgaagggagagtagtaggagatgaggtcagagggatatggagagtgtatagatcagtagggccttgtaggtcattgtaataactttgacttgcactaggagggaaaatagcccttggaaagtgttgagccaaggagtgacatgacgtgacttcagttttcacagtatcactttgtcagctgtgttcaaaattaactgtaggagagcaaaggtggaagcaaggagatagattaggaagtcactacagaaatttagttaagagctgatggtggcttgaaccacatctttgcaaatggcagaatgattatcatgggactggatagctgcttggctattggaaatgaaggagaggaaggagaacaagatttggaaatcttaaacctagacaagtggaatgcaggtggagccactaacaaatgttaccctcttgtttgtaaaatgagaggctttgactagattatcttgaattccatctaacttgaatagtttctacctctatactctgtggtttactatagataaaaagtatgttaattccaaagaagagtactgaggggaagggaagacttcagtctcgtcccataggaccaagtgaaaatattgctagcaatgctttttttcttgtgtctgtctcccatgattaaactgtcaacatgtattcaattgagatacagatttgaaacattttaaacatatgtgtaccttaatttagataatttgactaaagcaaaaagtattttcccttcatttacattcttgctttggagatatagatgggtttccagcctggagtttataaccccaaaagatgggaagagaaggaaagcagtagttgcatgaagaactgtataatctgtctcaaaaacacatgtggacaagcgcacatagggatggtagcagaattagttcaggcacttttgatactttgtcattttctctctgatttggtattgcaggaaatcatgaaattggccattgtgtttaaaacagttttctataacccactagaaaaattaaggagaaaatacctggtagagagagttgcagggtgaattcatccttcttaaagtggtttcagttctgatataaataattcccacttttttcctaggcagtaaagattgattggggtttgtgtcagcaggatgtgatgaagacatggtatagagattagaagtttagatccctgagggaatcagtggattaaaagtagaaaagaaaagagttatacatagaatagtatatttgccccagctgatctggggaggatggtctttaacagcattggattggtggtatttgaagacaattttctgagatccaagcaattttcattcacttaaaactcataatggaatcctccccactgtgagaagaccctattttttttttagtgtgcatgaccaagttgatatacattattcagcttctgttgtaagaaataaatgtataggatctggcagaacatttaattcaatttctaacagacaattaaaaaaaatctggttctttcctaatcacacccctaattggcacttcaacatatttataataaaaactatatttcatgcttatcatacattattgtaaggtcttgaactatcccgtgaatcatggaacataactacattattaggtattgctttagtattgctgtacttaaattcttcaaataatgttgctcatatatgttcaattttatgttcaaataagttcaattttatttagaatattttaaaaatatttctaatttatttataaggatagtttttaaaaataagttcaattttatttagcatatttataaaagtgtcctttaaatatccatcaggaataacacagttcttaggccaagctgtttcattatatttcattcttgttaaatgtgacatttttcctattgtacgtggtgttgttttttaaatttaggtatcttagcttgaggattcatttccaaacttatatatagcatgccagggcttatgattttgttgtatcttttctcacatttcagcactgtggtagtgacgtctgatttagatctgatttgggacattgggagccgtatttaaaaacaaatatatacacctttgccaaaccttcatttttaatcattaaaaagatttttttctttaaagaatgtattgtttatatgtttgaactttctgattctttttgactgtttacagttaataaaaatgaaaattattaaattattttattgtttgatctatgagtttctcttatctgatgggttttttttgtttgtttctttttggttttaatagaacattcaaataaaaactttggcagatgatgtggtaaggtggtcttagcatgttattacattacttatgcatgttgccttttaattaaaatgggtggacataaaagcattgatatatgtaagatacaaaatgtctggatatttacaaagtatagtagaatggaataattgtcaattcagtgacttccttttcgaatattaacacaaacaattatatgagatcccaacagaattttcatatcatcctaatatttaccttaaccaaatgttttttaaaatcttgtgaatctagactctggaaaacacagatgcttccttttttgatggccaaataaattgtgaatgtattaaacattaatattggaggaaattaatttccattagaaaggaaattaagttcactgttagtcagatgtgtgctactaaatttaaaaaccagtattttaaagctgaatttgtcatagtatatctttttaaaagttatgggctcaaaatgtaaatatacccttttatagctaaactataaaaaatggtattttaagccttgtcagttttttttttcctatgtgaaattacctatttacaaataatttaaagtagtgatagtgctcaaaggagatgaaggtatgtggcttaactacattttctttttgagacagagtctcgccctgtcacccaggctggagtgcagtggcgcgatctcggctcactgcaacctcgcctcactgcaacctccacttccctggttcaagcaattcccctgcctcaccctcccaagtagctgggattacaggtgcccaccaccacgcctggccaaattttgtatttttagtagagatggggtttcaccgtcttagccagactggtctcaaacttttcctggtgatccacccacctcagtttcccaaagtgctgggattacaggcgtgagccaccgcacccagccaactacattttcttaccaaggtatagctgaaatcaaaagctaattttctagataaactgaaagacacagtggaatatcaaatatatatgttattaatgctactcagtaaaaaggctagtactggaaaagtaaatattaagtgatatgaagggaaaggagaagagatatgttgatttaatggtcagttgcatatttaaatgctttcatgtccaccatatttttagtgaaatttgactattggatatatcctcagcttattttggattacttaacttttttcttgagttgtttgaagatatactatataactaaaccaacttaatttccctcaaaaagttaaaagaaaatgtgaaaatatagttcaagatgattagaagaaatgaatcttaagttaatgtgaagactgggataggaaccaggggctgttggatttaggaaaatcaccttctctgtgaaatgaggggattggtttagattatttttcaagtttcttctcagctctaaaatactatgatttatataatgtctttgtcagcaactgtgtactcaaattgcttttgtaatcctaaataagctgcttaaaactgctcatatttctttcaaagtatactttttggttttaaaaaagtgttctttgaatttaaaataaaagttatgctcattaatgaggagttcacataattttacataagctatggtaataacttctgtgatgctctttgtattgttgaagtaattatataaggattctggttacatggcggtgaagatatattctcctgatatttaacatatctgcttgtttaatgtgagcttgatggtatgcatgtgcttcctaacagaaaccataataaaactgagttgcattcagttttatgcacattactaacttttgatgtcccatgttttgtggtttaaaatagaatatcctatttacatgcaactgaagtcattaactcactttatgtgaaatagcaagctaattattagagattttacatggaatcagtggttcgaagtcaatatccgtaaaatagcaagtttttcttaatgatatttgtaggaataagaaatttctgtttgttacatttccagtaaatggaaaagccgatgtttttatctttgttttgcttcctcattggcccaacattttagggaagaaaatgctgggggaaaataataatagtaacaacaataataaatagcagctaagtgcaataaacatattaacttatttaaatttcacagtaaccctatggtgtaagtaatatcattatccctatttcagagatgaggaaacagagagagaccaagtaaactttcacaaggttactcagctagtaaatggcagagcttggactgaaacccaagtaatctgtcttgagtccacgctcttaaccattctactgctacactgacacattattcatttatacttgtcacaatttttgcaactttgaaggagaaaaacattaccataattttctcttagaattggaaatcagtagctctttttcagtttctttctcttttttcatagttctaaagttgccaccaaagacacactctcccagaaacaaccaacaggactttgatccgagactttttttttcacttatttactgtgcaaaacagaaatgacaagggactaagttttacttttgaagaatacttttcacccccagagttctgaggctgaagagtacttcaaggtttcaaaatagtacaatctctaactggagcttgctgcttaaaatagtattttgtcagaagacaataatgatatgtattatactaagtgccgttttgatgtttcaattcttcatgttagtagttcttgatctttttctcagggctttttatttatttatttttgtttgcagcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggtaagttatacccctaattttgatgtaattttaaaatgtgtgtgcccagaatagcactgagttttaaggaggtgtgtttgtatggacagtgtttatatcacataaagaagagaccagaaacttgatataacaaaactatttgcaaaagtatcctttttttttcttttttcttggcaaaaatgtccttacctgtctatctcttccactgtgagctcctaaaagtagaggcagttttatttatctttgttttctactatttagtagtctctaggacatcgagtcagtttttcagttaactgatttgtgtgtctgtttctacaaagcaaaagaggcctaggtcctctgctgaaaacatcacaaggtctcttgttgggtatatgaaatagacttgggagggtagagagtaacaatagaagggacagagaaattaattcatccaagtttgttctattagcaacattcacacaacctacattttctagcatgtttcctgtgttttatagcttgtggcctaaatcactgcctatattagataatgaataccatattttgagtattcagaagtttatggcaggagaggggagagatgaggaattaaaccgtattacattgttaatttgaccagagaagaactagagatcttgatttgtgattcattcattcaaaattatatcccacatgttactgtacattttttgtggttgtctatttacctgtagttgtccacaggagtttcaaaggtcgccttacaccaaaataaaaggttaaggatcagtgaaatctagaccctactgtgcccactgtggaacatcttgtcatcacctctcctgctaccctcatgtttatttctctcctgcacctagaagagttagtaggccttgaataaatatttgttggtagctgttgaatgaatccaaacaaaatttccctttaaaattttccttgactattccttccatctagccacaactggcattttgggtattcccctgaaacgagtcctgacacttttaccctttttcactcttcttcctgcttctgtggtgcaccctttttcctgctgctcctttcgtgctatcttctttaaaccatctttcaacaaccttttctcttttgaagtctgttattgctgaccttccttgatgatagcacctggctatgcttttgtcctttacccttgctactcattttggtgatttcaactattacgctaatagccttcaatacattttttgctcttagttccttgtttgctaaactctgacttttgcatttatatatttagctaattataggtatgactgtaccttggactgtgtcatcctttagaataattccacctctaagagctttaactctaaaattttccttagaagctaaacaatttacactacctttccaagacccttaattttatagagcatgtattgtgtagtggttaaaaacctggactttggggtcattcagaatgtttgtagtgtttctttcctttatcaaataagctctgttgtgtctttaattgctagtattttctgattacctagatacccctcagtttatcaccctggtgtccttaatcactgaaaacaatgatgacagcaacaaacacagaaacattccttgatactattaacactttttatctttttaaatctttcttctctttaaataaaaattatactcattgctttaagctgctgacaatttggttactaccttttgcagtattgaaatagttctccgagttcatcagtggcattgctgtattcagtttttctacactgagcattacagggctatcttcccttcattgattatctcattcacttctaatttcttgccaaatcccattggttttgcttttgtaataactgttacatttgtgtcctcagatgtcctccagctgttcttgccctactttagatgataaccctctctagttgtttctcatggctattaaaatagcctcccaactggtcttcctcccatcctccaggttttgcctattccaatccagtattgccctatgatttggacacagagttcttttctgaagccccaggtgggcctttatgttttcagagaatcagtttatatgtccctactccgttccctcaactatgcccctagatgcctttcacacctttgcttttctgctccaacctcagagctcttccccatctttattctctgctgatgaccttgctgcttaatttacgagtaaattgaagcattcagaagagaacttccacaggctccccccaccacatttaccttttagtatctgcattcatgtatctgtcttgctacctatcaccatagatgaaattttcatgtccgcattcttctgcttgtgtataaattttcattcctttcagctactcacagatattgcttcaataattttttcttctctctcctaccattctgagcagcatgtaaacatgcggtcccatttttcaaaagccttcttttgaccctttctctgttgctagctatcactccatttatttactctccttggaagcaaagcacctcacaatataattttattcatatgcactgcttccagttttaatcctctcactttctcttctaaactcactccaaccaggtttccatcccaccattctatcaaaactgctcttatcaatgtcaccagatatcttcatgctgccaaatcccatggtcaattctcagttctcatcttaatttttttttttttttttttgagacaggatctcactctttcacccaggctggagtgcagtggcataattatggcttactgcagcctcaatctcctgggctcaggtgatcctcccaccttaacctcccaagtaactgggaccacaggcatgcagtgcaccaccatacccagctaatcattttgtattttttggtagagaccaggtcttgctacattgtccaggctggtcttggactcctgagctcatgtgatctgcctgccttggcctcccaaagtgctgggattacaggcatgagccaccatgcccagtctctcatcttaattgacctatcagtagcattctgtgcagttgattattctctccaatttgaaacactttttatttttttgtctcctcaacattcatcttgttttcctcctacctctcaggccactccttttcagtcttctttgctcattcctctttatgtcctgaacctctaaatcaaatttacattcaacttagtcctcacatttgaactccagactcatatattaaacttcataaccaacatctttccttggatgcacaatagatctctcaaaataacacaaccaaaactgaactgctaatattcccctccagacctgctcctacaaaagtcttccctttctcagttgacggtatctccatccgtccacctaggccaaaaactttggatttgtccttcactacccttttctcacattctacagtcaaaccattagaaaatctcattagcttttccttcaaagtaaggcactttcaacagctgaccatttcttacccacctccactgataccacactagttgaagtctcagctggaccactataataatggtaggattattaggattaccacaacccctaattgatcttcctgctttcactcatgaccctctattcttagcacagaaagattattcatttaaaatatgaacatcatgtcacttggctcctcaaatctccaccatggttctcatgtcactcagtgaataaaagccgatgtacttgcagtagcttataagatcctatatgttttgacacccaccacaccttacctttttgatatcttcctctactattctctttccgctagctcacagcttcagttgcactcatgccttttattttattgtagctctaaggaacaatgattcctgttagtttttctttcttttttttttttttgagatggagtctcactctgtcatccaggctggagtgcagtggcgtgatcttggctcactgcaacctctgcctcccaggttcaaacgattctcgtgcctcagcttcccaagtagctgggattacaggtgcatgccaccatgcctgacttatttttgtatttttagtagagacggggtttcaccgtggccaagctggtctcgaactcctgacctctggtgatccgcctgccttggcctcccaaagcgttgggattacaggcatgagccactgtgcccagccgattcctgttagtttttaatttttaaatttatgtacaacatttacagtgtttttaaacttcgtacatttctattttgtggtttgaatatcataatgtttcatcagaaaattactatttcctctttatgattttttttaaaaaaggatttgcttgttggattcataaatgtgatttaaagaactgtacaactttgtgccacattttctcaaatgggaattttttcttccatgggaattttgaaataggatattaagaaaatatgtttttcaggtactatcatattgtgttataattttatttgatggatctcttttatgttatgtgacccacataatcattatagacttgtatatgcagatattaaaatcctgtttatatctagtagtggaattgctggatcatatggtagttctgtttttaatttttaaaggaaccttcatactatttatcatagtagctgtactaatttacatttttaccaacagtgtatacaagtccccttttctccacatcctggtcaacagttgttatcttttgtcttcagtaatagccattctaaaagatgtgaagtcatatctcattggtgtcttaatttgcattatgttaagtgaaataggctaggcatagaaagacaaatagcacatgatctcattcctatgtgaaatctaaaaatgttgatttcatagaagtcgagagtagaatggtggttaccaggggctagggtaattgggcagtggggagaggggtaggttgaggagatagtggtcaaaggatacaaaatttcagttagatagaggaataacttcaagagatctattatacaacatggtgactattgtatttttgaaaaatgctaagagtagatgtaaagtgttctcaccacaaaaatcacaaccatgtgaggtaatgcacatattaattagctagatttagtcatcccacagtgagtatatacttcaaaacattgtgctgtacatgctaaatgcatacaattttatctgtcaattaaaaaaacttatttataaatggacatatattatttttaaataacagtataatataataggatatcagagaaatatggtttgattaaaagtaacaaccaaaagttaaactgaaaactttaaagattatctctctactttgagagaagtctacttataccctgaatattgcgtattttctatattagtttgacggtaataaccttacagtgaacaaattattttatgaataactatagttttcatctactgtatacttatgcctaaggcatgaaactaaaacatttaagtgtattatttcaattgatccttatgacagtgccacaaagtaagtaagattgttataccccattttcagatgaggaaagtgaagcttagagagaggcaagaaaattggttcattaacttgactaagctagtaagtagctgagccgaaacttaaatttaggtacataaaaatctaaaacattgactttttgtaacatctgcctttaataatgcttcatttaaactaaatataaaattagtacattttccttgcacacatagtgaggagaagtagaaggcaaatcagaggtacattagagtggtaggtaaagccagcctgggatggattatttcctactgataatggaacattgtctgtaattgctttttatggagcatcaattgagaagaatgagtccaaaaatctagcaatggaaaactgttaaaaatgtcattatcacagttgattgggagaaagcacttaagtcattctgtttctaaaacacggaagtagacttccagatatgaaatttatctttttttatttcactccttgtgggtgtctttccttgtacaaataacgtaaaaggtgttcttgtcgtatttgatggctcttatgacaatcttccttcttctgggtcttttgatggtagctttattgtgctgtttctcttgattggcttttctgactttagagaactacaaaggtttagaccatttggtttcaatactatatatgtattttaggataacatactttgaggtgtaaaacttttttttttttttttgagatggagttttgctcttgttgcccaggctggagtgcaatggcgcgatcttggttcattgcaacctccacctcctgggttgaagcgattctcctgtctcagcctcccgagtaggtgggattacaggcacgcgccaccatgcctggctaattttggatttttattagagacgggttttctccatgttggtaaggctgatcttgaactcctgacctcaggtgatctgccagcctcagcctcccaaagtgctgggattacaggcatgagccaccgtgcccagccaaaacgttttaaataattgcagcacatagcatgagattatgcacagtaataatatatgagacacttgacaagaaataaattaccttacaatttactatttagaatttctgggtaatgatgtattggtgaaacttttggttaaaaacttaacaaaagataatattcaaatataatcctttcttactctgaaaattgaaactcttgttatacctgaggatcacatctatcaacagcagttctcattggataggcttgtagatgtagataattgagctaaatctaaaattactgcaggatatgttttttctaaaagaaggtagctgtttttacttaattactaatagatcatttcacaaatcacttgattcttcatagctaagaaaaattgtgaaatgagtccagttaactgaaagatctgagtagtctggttttactagtgtattagtagactactaatgtctcattgactctggcatctattctgtgcattggtgcatcacttttcatattgtgcttattcaatgatgcaattttaaagggactttctaagtaatggtatcaatggctattgctggcaagtttaaagttccaaatttgaaataaatatttatttatttttttgtttagagacaggaccttgctctgttgtccaggttgtatcatgggtcacagcagcctcaaactcctcggctcaagccctcctcccacttgagcctcccaagtatctgggactacaggcatgtgccaaataaacgtgatttttttgtttattttttgtggagatgaggttttgccatgttgcccaagctggtctccaactcctaggctcaagacatcctcctgccttggcctccaaagtgctgggattataggtatgagccacggcacctggctttgaaatttcttgatgattgtttattttatagaatataagctctttattaagagagtgtctttcatagtttgtaaaagtgaattttgtatttagagtatggttaccaactactaactgaaaattgagaagtggttcttttactaaagttttcaagaattaaaaccactgcttttataagattgataaaattacctgcatggggtaaatcacacttgctctttaagattcttgtctccctcccatacccagagtcatgttttcaaatcttccacaagtgggtaaaggtagtaggatgaaaacaatactccttccatgttattattattggtaactttttttttcttttgttttttttgtttgtttgttttttcgagatggagtcttgctgtgtccattaggctgtagtgcagtggtgtgatcatggctcactgtggccttgaccttctgggatcacacaatcctcccacctcagcatcctgagtagctgagactgtatgcacgtgccaccatgcctgcctaattgttttgtagagtgtgggtcttgctattttgcccaggctgatcttgaactcctgggctcaagcattcctactgacttggcctcccaaagtgctgggggttacactgtacccagcctatatttagtgacttttaaagatgactgaactaaagcggttcatattcgtaactcttctcatattgatcagaagcattttatattgcctctaattaggattggatgaaatatctcctcaattccactttaaatgtaaggaaattaataatgctgtaattgagtaactcttcaatattttaagttgtcataacctttgagcttgctgagaataactgatctggtttttgtacattgagtatactgcttagggactgttaaatgcttattagtgttttcatctagactgaattatgcaattagagttctttttggggagaggggtgttgggagaggggagattttcattttaagattaaaaaagtaaacccatagaaatttcttgggagttcatgttggaatttgatttctattagcagcacaaggaactcccaagtggaggttcaggttgcattggcaacatatagatacgtcaataaggactgtgttctgatataggtaattaaatagtttgtcttatgcaaaagatgaggctagtaatgatttatgattaacctctagccatatttcatttcaacctaatttgttaaaggtaatgtttaatatatgattatacatgcaaatttgatgttttacactcttttctattcagcaatttatattaatatactttgcatttttgtcataatttaatgataatagttatatgcaataaatactaaattattccatctgctagaactctcataagtaatcccaaaccttttaatttttgttctctcacttttctctttcattaatttagagagaatagttgtgcttgaacaccaggtgttatacattaacccaagcatccttgttctccactgactgctattataggtttctttctcacccaaccctagtcttttagaagttagttagcttggatgaatcttttcatgccctcagaataagtaattttaattaatagtttaaggtagcacaaaataaattattggtaaactaggtcttaaaatctataataagccatggaaatagttgtcagaaatgattagaatctcagaaattgtctagacagcataatatccataggttatatttacattttcaatatccttactccatatcattagacggagataatgccagaagcatttctagacaacatgttttattttcttataaaactcctatgacgagcttataaaagaggagcaaaacttacccagtaaacagatctaaaaggtaactaaatctgggtcaatttttaattttattgccgagcatgattttttaaaaacttggctctgttcttgatttgtacagagaaatgctttcaaaaatatttcttctgttttgaaggattctactagtatttatttgcatgagtgtatttaagcaactatttattcatatgtgcaatgtgccaggtaggatgctacatgttggaagtgtaaagatgaatgcaacacctcccttaccctcagagagctcagtgtttactcagggagaaaagtacataaattatttccatagcactaggatagctgtgaataggctactgtgggaacttagccctgtgtaggggctcaggatggaagcagagaacaccacctaaatacactgtgaaacccagtgttacttctgaattatccgtctttattttttggcataaatgttctcaaaatttgaacagtttagttcatcaaagtcccatgccttccatatgcccaatactgttttaaggtctgagaagagagcagtgaacaacttaaagaaaatccctgccatcaaggagcttatgttctggcaagggtgatatactggaacataaggtggagttataaaagaaaaggaaaagacaaatatctgtgtcatggtgaagtttatttgacaactctctactgaatgccagatactttgttaggtacagcagacataaagatgtcaaaggtactatccctgccacaaggtttttattttgtatatcctgctgactaagaatggttttatatttttaaattgttacccaaaaaaagactgtttcagggcacatgaaagttatatgaatttcagtgtccacaaataaagttttgctgaatgtatccacgcccatttgtttatgtattgtctatagctcctttgtgctacagtagagttgagtagttgagacaaagattatatagtttgcaaaacctaaaatatttactgtctggcaatttacagaaaaagtttgccaacctctggactagtccaagagtctctaaaccttttatttcctaccccatcagaaaaaaaaaaaaaaaaaatatatatatatatatatatatgtttgagtaagtagccctaatatattttaaacattatatacatgcatgtatgtactaatattaatatgtacattacaaaatatacacagtaaaaatgagaaaaacatgaacaagattttaaaatgatttaaaattagtttatttcttaatcatacagaagtctttgctgtcatgattaataactttttagtgagaacagtgtcactatgtcatttttttatgtcttgcttaaaaataggcggtaattagaaagtttagctccaagttcattttattttgatatttggtttaatttctctcataattgaaacataaatctgacaaagatttgtaggtccaaatcgaacaaatgcaccattagcaacttactaaattgtagtattaacttttatcagaccaatccatgaatcaagcaaagatttcctgctgaaccatgactagtaaattcctgtcttacttgatgacagccagttattcttgcaactaatctggggtgttgcatttttatatttctaaataaatgggtttaaattggactttaataaatgggtcttcaacaagtgccattgggaagatgggctctttccattttttcttctacattattaatgtgtagaccctcatcctcatgtttgtgtactcatgcctgttccagacagtacatctaacaccaggaagaaagaggaagtaattcaagcaagggtgaaggggactgacttggaagttgagtctgttgggactgacttggaagctgggtctgtctgtgtggcttttccagtaaagtaggtttgaaaaggagttactttcttactaattgttaaaacgtcaaggaatttcttcactttttgtaaatgaaaaatgcctaactcatgctatatttcaagttttttttttttttttttttttttgagatggaaactcactctgtcacccaggctggagtgcagctgcgcgatctctgctcactgcaccctttgcctcctgggttcaagcgattctcttgcctcagcctcctacgcctggctaatgtttgtatttttagtagagatggggttttgccatgtcggccaggctggtctcgaactcctgacctcaggtgatccgcccgccttggcctcccaaagtgctgggattacaggcatgacactgtgcctggctaatttcgacagttttaaaatactttatcttgaaataaccagaaatatctctggttttcatgttaacttcctatttcatttcaaaatattgtaaatattttattgtatttgaaatatcttgcttttatttaaagaagaacaatcttcttgactctgtagtattctgtatacttcagtttcaacttcttgcaatggccttgaattttacgtgtaggtttacctgactcaggaatccttccctcatagtttttccacaaaacctctttttattaaataaatcatttattttggttatgtgttttctctgttaaattgttctaacggtgacacaaagaaaagtagtttatatatgtcattatggaaacaatctagcaaatactataaggtgaggtgtttttaaaaaggttatatttttatccaactgtatagtaaacctcctacactaattgcttaaatacttgctttagcaaattttcagtaatgatctatacgtgtcttctgatacgtcagtatttgctgacaaagaaatgtacttcagcttcctgccatgttgttttgcatggattgtttcagctgcttttaccaagtgtttctctaatgccatggtaccttttgtcagttgttattaaagaaaattcatgagaagcttctaaacacatatcattaagtttacaaagtatcactaaggtactggatttgagtataacattctaattattgcggagaaaaatgacgaatgactgagaattgaagaatgaatgaatgagaatacaaatgaatgaataggcagctggttcaacttttgaccttctcatttgatcctattcttatggcttctcagtaatagctttaagaatataatgtttgctgaagtgaaggaatttgtctataataggaaattgtatcatggcatatgagaagcataaaaaaatggtttagtatttacaaatgtggctttaaaaacattataggctgggcgcggtggctcaagtctgtaattccagcactttgggaggccgaggcaggcggatcacgaggtcaggagatcgagaccatcctggctaacacggtgaaacccagtctctactaaaaatacaaaaaattagccgagcgtggtggtgggcgcctgtagtctcagctactcgggaggctgaggcaggagaatggcgtgaacccgggaggcggagcttgcagtgagcctagatctcgacactgcactccagcctgggtggaagagcgagactctgtctcaaaaaaaataataataataataaagaaaaaataataaaaataacattataaatggtcaactagacttcagtgttttgtttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacagggtttcaccgttttagccgggatggtctcgatctcctgacctcgtgatccgcccgcctcggcctcccaaagtgctggtattacaggcgtgagccaccgcgcccggccgacttcagtgttttttaaaatcacaaaatactacattttttctcatgtattatagatatatcaaatgttaaacatgctaaaagcttgcttttgttttgaataccataagaaatcagtatgtttagaaatagtttcatattcaattacgctgtttagagttaatattgaattatgaatattgctctatttagctttattattgtattatggatctggagttaatgatttggaagtgttagctgcctaattagtagaatgtatcttatttctatagaataaaatgagtcattatggtcttttcacatgaatgatactcatttccaatcaacctatgcagcaaatttataagtataaaaaactgttgctgattctaaagcaagttaatatatttaaagaaaaggtcttaaatatcacattggttcaacaaatatttattaaatgtttactgcattccaggaattatgctctttgctaggagtacaaagataagtaagttcctattttcagcttcgagtttagaagagatagatttatcacataatttcaatgtaagtgacacataaggaattaatatggaagactaggataagggtaattattttcaaatcaggtgctttaggagaagtcttcctgaaaaattagtggttgagcacagtcttgaagtataatagccagatgtgaatttggagggggcaaggatgggcattaacagatggagaggatggtaaagatgaccacatttcaggcagggagaacagcgcatcatgagcaaaataatgagtgtgtaacaacacagtttatgtagcaaaactacaaacaacctaacattattaaaacataaggggtaagatgaaaagcggttaaaaggctgaggttgggaggtgataacgctaatagctagcattctttgaaagctagttaatatacaccaggcttgtcatgcatgatcacacccagtcttgacaacattcctctgaggtgtataatcttacattgctcttattgtcctgcctgcctccctacaaaataattctgtgatggcgtgatatcagcagtgtgtgccattaaaaactgaatgggtacacggtaatgtagaaatgtcactggaagcagagaaactctctacctagagactgccaaaggtgacgccaccacactcttaggccaggctgtgaagtatacaaatacagacacttaatcttgtcactgttccagagttgattctacttggaggttgcggattgatgataaccacatttacaggagactgaaatttaaccagaatttttttaggcaatagagacatagcccagcatatgtgagcagaacatagggattttgatgaaaacaaaaacaatatgagtcagcagaatgatgtacttggccagtaagataataaaatcaagagggtgaattaacagaggtgtaagtatttcaaggtgagggaggtggacattctttcctaccttgcatttgttaaaccacagagtatttgagagagagagagatgtggacaccaacccatgttacatgaagataagttgagtactttagcctgaaagaaggaatgtggtcttcaaataacatttatgtggctcttgaattaatttccttctgtccaatctgagttttcttcttagttcgactcttatctctagtcacttaaattacttcagcccaaattattgaacataagaaaaatccactctggcaggtttaaatagaatataattttagaggatattacgtagtcttgaattaacagagttgcagaaacaggctctagataacattataggactaacttccagaaccacacaactgaaatacagttccaattaaggagctcttatcccagaactatttgatcaaaatgtcttaatgaaaaagacacagttaatgccatcagttctgtaacaacatcacctctgttgccacctacatcagcaaaatgaatggcctattcgtggcctgcttcctcacatagttcacttctaaatctacacctcctatgcatgcattttattggtggagactaagccacatgcctgcactctagttaaaagggagactgacaaatgtagtttttatggattctacctttgtcaggtgggactgacaatgtgaggatgtattaaattgtagagggtatgttcaagtgatgttgagcagcaaaaaatgacacatgaccgctagagtttcctgaccggtctccttccttccagtcagatttttttcatcctttgagacccacaacctggtgaagacttctctgacctttccatctgccctgtgtttccaaagaatctgatacatgcctcagttagaattatttgttactactggaccataaattatttattcaacaaacatatatagcatttactaagtatcaggcattgttctaagtgctttataaataatatgtaatttgagtataaaaacagtctaccagattagacagcctagcatagtttctggtgtgtagtatgtgttcagtaaataagtgattcagaattttaaaagagaagaaaaaaggtcatgccacccaccttaacacacattattttgttgtacatatttcatgtccaatcattgaaggaaaaatttggcaaaaattaaactaccctaagatgagtggggctgtctgaggacgtagggagtacactgtcagttgaaatagatacatatgctgggtgtggtggctcacgcttgtaatcccagcactttgggaggccgaggcgggtggatcacttgaggccaggagtttgagaccaccccagccaacctggcaaagctctgtctctaaaaatacaaaaaaattagctgggtgtggtggtgcgtgcctgtaatcccagctacttgggaggctgaggcaggagaatcgcttgaacttgggaagcggaggttgcagtgagccaagatcaggccactgcactccagcctgggcaacagagcaagtctccacctcaaaaaaaaaaaaaaaaaaaaaaaaaaaaaggaaatagatacagaacatagatgagcatctgtggaccacattatgagtgctatccaacctagtttctgtgattctactgtgattcaacaatgccagagcctatgagagagagatgaaaaagatgtcttctgccttctagtaagtcattaacaagtaaaatatccaaatgagaaataacattagatagaaaagtggggatagggacagtgatccagataattaggaagaaaggtcatgtatatatacacaaaatttataggtattgactatgaatgaatcatcataggagttgctgcagtggttgcaaatatagatttttgctgtcaacaaagttattattcaatagatagatgcaatttgtctacttttgaggattgtcttccacattctcacatatgcatctttaaaataactttgatgccaggcgtggtggctcacgcctgtaatcccagcactttgggaggtcgaggtgggtggatcatgagatcaggagatcgagatcatcctggctaatgcagtgaaaccctgtctctactaaaaatacaaaaaattagccgggcatggtggcgggcgcctgtagtcccagctactcgggaggctgagggaggagaatcacttgaacttgggaggtggagcttgcagtgagccgagatcgcgccactgcactccagcctgggcgacagagggaaactccatctcaaaaagtaaaataaaataaaataacattgatactgttcttcgccaattagtttatttactttatcaaaaaaaaaaatagaatgctcagaatttctgtaagagtaaagggataaaaatactgatttgttttcttaaaaaatttagatatgattcacataccataaaattcacccttttacaatgtgctcttttttttgctttttctttctttcttccttttttttttttggagacagggtcttgctcagatttccaggctggagtgcagtgacaggaacacagctcactgcaacctctacctcctggtctcaagcgaccctcctgcctcagtctcccaagtagctgggactgctggtgcacaccaccatgtccaggtaattttttaaaagtttttatagaagcgaggtcttgctatgttgcccaggctggtctcaaactcctgggcccaagtgatcctccttcttgggcctcccaaagtgctaggactttggcgtgagccactgtgcgtggccaaattcataattttttttttgtatattcaaagagtgtgaaactagcacaacaactttgagaacagttgtatcaccccataaagaaacaccatacccataatcagtcagaatccaaactccctcctcttctcccctggccctggcaacctctaatttattttttgtccctataaatttgcctatttgggacatttaatatgaatagaatcatagaatatatggtcttttataatgcttctttcacttagcataatgtgatttcaagattcatccaggttatagcatgtatcagtacttcattcctttttagagctgaataatatttcattgtatgatatgccacattttgtttatccattcgtcaattgatggatgtttggattgtttctactccttggctattatcaataatgctgctatgaacattcgtgtgcaagtttttgtatggacatatgttttcattttgcttaggtatgtaagctgggtcatatggtagataaatctgtttaacttttggaggaactgccagactgttttccaaagtggttgtatcatttctctttcccaccagcaatgtgtgagggttccaattttttcaattcgttgccaacatttattattttcctctttttttctagttatcctagtagaagtgaagtagtatctcactgtggttttgatttgcatttccccacagattaatgatgttgaatatcttttcctgtgcttattggccatttatatatcttttttttttttttttttttttttgagatggagtcttgctctgtcacccaggctggagtgcagtggtgtgatctcagctcactgcaagctctgcctcctgggtttgcgccattctcctgcctcagcttcctgagaagctgggactacaggcacccgccaccacgcctggctaattttttgtatttttagtagagatggggtttcaccgtgttagccaggatggtctcgatctcctgacctcgtgatccacccgccttggcctcccaaagtgctgggattacaggtgtgagccaccgtgcctggcctgtatatcttctttagaaaaatgcctattcaagtgttttgctcatttgttactggactcttgtctttttattattgagttgtaaaagttctttgtatatctgggtacacatctatatcagacatatgatttgtaaccattttcacctattctgtagattgacttttcatttggtgttgcattttgaggcacagccatttccaacttggttttgtgaccctgtcaagggtgtcttcatatgtcacaaggattaccatgaatttcaaaatgaagaaaaacaatttgtctaatcaaagtgttataagtgtatatatcacaaaataaaggtagatttccaactgaattaaagtttattgaacctcaaaacaatgtgttcttgtaactgaatacttttccttctaatgagtgacatttattaccgcaataccgctgtttctgcttttttttcttttccaaatccaacaacttcttgtgaactttcttcagtgacatattatagatatatagaccctgacaatttgcaaattgtatttgctttcccaggtaataatgatcctaagggagcatatgccaaacagcattttgtgtgtgtatttgctatcaagataaataaagagctttgttagcatagataccatgtatatctatgttataaactgccaatttattctgtggaatagttttaaaaatatttttttctttctgctcagtagttggctaggtagagatgtgaaccgtgaatacatggtagaatttacacaaaactgtggtatctagagtgaaaaataatagcgaagtatcccaaaaaaggatttttgacattagtcaccacatgaattagtattttaagacatagaaattattaatgtttactaatcacttttgaagctcttaagtggaaatttatcaatgcccacagtaaatgttatctcttacaggaggacatgaaccttaacgaagagaaaaaagctcctttacgaaacaaagactttaccaccaaacgtgagatggttgtccagtatatttctgccactgccaaatctgtaagtagggagatttttctagctccaacagaatgagcaatgagcttagcatcattttgcttaaaaataaacaaacctcagctcttcagattacctcattgtactcatatagactgttcagaagacaatttatatatgttatacatttagtattaagtatatatttttaaactattcatcattagaaatgggacgtttccattattacaagcaagacaaaggatacaaagctctgaggtaatccagtccagtcctgagcttttgtgtacatactaaaaatcgactgcattttgcagatattccaccaaaatgtggtttgttagatgaaaatttcggattttgaagaaggtacaacttagtatagtcacagcttaagtttacattaaagctacatgtctggtgtctacttgcatgaaacttttagccatattttttaattcgcagttagcttttttcataattttatatgatgcaaactaagctgcctcataattgctattgtatagcttcatttaatgtaaaggatgtcacctaataggagctttaatcaaatctgtttgtgagtcccaagacttgaaagtaaagttcattgaaaggacttgttgttattaggaaactgtgtgttttagtggagtattttgctctgttctcttcctaatgcacttccaaatatagtcttaagctttgatttttttttttttggtaagaaaaaattgtatttttgaaatagcaaaatgcatcttttacatttctgtaaagaaaaagcttttaatacctagagttcataaaatcactgtatgtgtgtatatgtgtgtatatatatgtatacacacacagtgatattttgtgtgtatacatatgcatgtacacacacatacactatttaggtcatgtgttttaaatttcataagttgaccattgcagaaaacaagtcttcattgaaaaaatatattctaaagttatttggctatcctattaatgctatttcagtacagcaattccagtggcaattactaatgcattttgccatgaattctacgattgtattgattctatattgtacttgaaacaagctaaatctgaatgctgagctatttaaacataacacattgcagctccgccatagcagagcaacagcatgtttttaaatttgcttctggtatccaagggcagaaatatgtttcaagtgataagtgaaatttgccatgagcgtcgttttcaatagaattaggtgatgcatagggttttactttgaaattctgatgaatctcttctcatttttgcactcaagttattgttcaccataaaatgctttaggaaatgcaggatgtacattcaatgttatttttcaaagacctaaaggctgatacactagtaaatctatatgactgaatctgagtgcaaagtacagataataacatatgaataatcatgtggtggttttaatgataagattttgttagagtctctggctcatttgttgttgtttgtgtaagtgggactgaatataatgattatatgaaactcttattccttgaccttttgagtattacatgatttctgtgcagaacttgttttcatttattctcatattatttcctcttcaagtgaccaaagaaatgcacacttcaagttatatactgatttttcagattaaaatgcaaaaaattggataaatattagatgagctcacttgaactgcattattcaaaagatggaaattcaatgttcctcaaaagacatgaaaattctatgtttaaggcattagcctcaaaatcagaactacttaagggcccttatttgtttcattcagtgtacatatgagcacctgaaatatgcacagcactctgataagatttccaggattatacatatttttgctaatatttttcgtgggccagatactatgatggaagaaagcctgttgacaagcatttttgaagctttctcatcttggaaagacgttaattagtactatgttttctatcattaaaaccacaaaaattagttatgtaatttccttttgaaggtgagagggttggccttcagtgacaaacaataatctaacctttttaccttttcattatcacagcactaaagtttgcatttagagtagacatgatagttaccactactttatgaaaatgctttctagttagtcacagctttcatcttgaggtagcaaagttaagagctagagtccctggtggagaaatgttttatagtcacatgtaaaacatgtgagaattgtagtgaaatttaaacgtaaatcatacattttccccgtttaacacctgcattaatcattttgtatgggatctaaaaccagattttagatagaaatgtctatcatgctcctgggttcttgagtaaggacataaaagtaaaatgaagctatacaccaatatgtggtcaaaactcgtttctaaagcaaacaagagtcttttgtcgtataattaactttgctaaaattagcatggaaaaggagactataaaggaaaccataagataataataaaaactattgcttagttttttcttctcgaagtcccataatagagaatgttaaattgtgtgaatgttaaaggaaaaagtttgaataactctgtccatgatgaatgaactttaaatagagggatggagaagaaccttctttctgcattttatcctccattgttcattgtaggaagcgtagttatggatctgacgtagggtaataggaatatgtagataatttgaccacaaataacctggaagagtctatattttcaaaacaccagcatatgttttcagaaaatggaaaaccaagctttgttaatattgcaaaagttgtcctaccgattggtaatcctgaaacaatatgttggtaatttagaggggatctcacgggcacttaacagcacatatagacatttatgaggaaaagttattcaccgaagtcccaacgttagtttgtcaaatgccagtgtcattcctagaatgttaagggattggtttattttgaatttaaatcataatctttgaaattttaaaatatgtaaagttatattttttaagacatgtgaaccattgagaggcagcattggtttttttttttttaatctcagtaggaaataatttaaaatagtggtgctagctacatctgcagatttgttagactgacctgtataatgagtagttaaaagttgcagtatatctatatgtgtatgtgtatacatgtattatggttttgcttttgtcattatcagatactctttcagctcttttccaggtatgatctggatatgatcaaacagttgaacccagacatggccaaaatattttctcttagcttctgttgggtactaaatcttatctattgccgtttgtgctttagctaaatgcagttattttgcaatgcaaatgaatcattaaatgggccatattctggttgtttcactgagtatagacctgctttaattgttaacgcaggctcacattcttttgttagtctcatgtctgtgctaaataaacaagggacaaatacgacctctgtcttttcggtgggaggaaataattgaggtcaatagcatatcttttaattcagaagactgttaatggcaccaaagaggcttttattcaactaaataatcactgcttgtaaatagtctactgaatgaatatttaagaaagctgcttctgtattctgagattcatggattcttctgaaataatttacttggaaactgtcattatctttttgtattttatgatatccttttcaacataggattcttactggggtttcagttaaatttgatttttatttttaaagcactagctgaaaaatagaacacattttgataataactgctatcggattaatggttttgtattgtggcttagctgttttttggacactgcttgatattcaagtgtgggaatctgataacagtgatttgatttatatttggatttttggataaaattatgtttaggactatgagtttacttcctgctttcttaaacacaattctgcctctcagaaattcttttatcacttatccattaggaaagctcagttggagctgcaatttttgaactatttcctccttctgaacatgtgcatgtttagatgtaaaatgcttctttgtcttcacattatgtagaaaattctgatcttataatagaaatgctaggattacctagaaaactagaataataagtaatctatcttttttataattttcaagtataatataaaacagtatcgtacaccttaaatttataacaataaaaaatatttgttttcaacctaaagtttacttctgaacttaatgcatgactttaaatgtaacatttatatactaaaataccttaatagtatacctgccataagaaggtgtactatttcaaccttgatagtatacctgccataagaaggaaagaaaagaaaaggcaatattggaaaaaacaaaatttctattgataattttttcagggactatgagctggtaaaaaaatctgatgcctgattacacttaacattgcataacttgatatttagattatactatatgagaagcccattatagtacattaaaaaaatcctcaaatagtaattatcacttatttgagaatccttattctgtagactttacacatttttgaaacatagtagaaattaatattgatgtatctattttagcctgtatatctaaagtatcaaaaatataaatagggttagctatttactaatttactaaacacttaacctctgtgaaaagcttctgactactaatattgttgctgtttgttttttttttacaccataaccactcttcgttgaccactgcatgcagatagttggaagtaaagttacggtgagtacaaaagatgtgttttacccttagatatgaatttgtggttttgtaaattgtgatttttgcttgtagtattttatatgtttggttcttttggtatatattttaccaaagcaatgagatgaatattatgatcaggtgattagaatttagcctggacaagtattttttctgtggtttttgggagatgttttagaactagaatatgcttgtatattttatcttagaagttttcacctttttttttgtttttggaattatgcctgtgtcagtctttatgattctgatgaaattgtatgttttacctcaatttatcaggaggagaatcctaaaatgttggtttatgctaacaggaattcttattaaaatatgtcactttgatttcagtatgattgagcacatagagtaatgaaaacaaccctttccatgcagtcgggaggcctgggtgcttgtctttgttgtatgctactaatcagcttttgctactttgggcaagtcatgtaatttctctggggctcaattattaaatggataaattgaaatgattagctgaaattatcttttaaggttctttccatggctgtcatttaaaggttttatattcaaggcactatatttcagtgctataattacatgatacactattatataacacgcccaaagtggcccgtactgtgattgagagctgtttgtaattaccttatcttcatgactaagcactccctagagaacagggtggtaggaaacattatctttaacatcaccgagtactgaggtatctagaatagtggatttatttgttcattttgcttttaaaaattgattccttcttttcattatcttactcttcttttttttttttttaaattcacgagacatctagggggaaaagccatcatcctttcaggataattttaaaaatcgaatatttatttagtgcttattatatgccaagaattattctaggtgcactgatgactggaaaataagaatgagataggacctagttgatatgtgttgaaataatcaaaccttaaattatgcatgctgactataaatgtaataggaattcataagtaggagagagaagtaaggttggagtaattagagaaaaatctgtgtaaatttctgcacttaaattgggctttcagggaataattagttatgatggctggtgtttggctagggaggagagactgtggagaagctctcagattctggaagtaatattaaatgcaaaggcctgaagagaaccaaaccatgtgtgtggaggcagagaagaaggaagtgagagatgaggttgactttgttgaaacaaagaatgtatattggaaagagtaaaaaatcaagttgaaggatggtcttgaagtccaggcggcaaattataaattagtttgagcaaggaggtaacatgatggaagcagtgtttaagaaaaataaattcgataggtggataggctggattaggctaatggttctcaaactggaaagtacatgaaaatgcaaattttgtcctgctccaggaagattgtgattcaggtggcctgggatatggccaagaaatttgcatttttatctagcacctccagagattctgctaaggtagtctgagaagtatacttcacactttaagaagtactggattctgatagacttattcgggaagctacctaggagatttttgagtgattcagtgaggacttgtattaaagtcctcactttgaggctaggtggggttaaataacgagtttggggagataagagatttttagcttattttaataagggctggaagcagcctgtatttctagtcttggtaccaactctctcccctaattacccacactgttacttccttagttcagactgtcatcatttaacacccctgtgattgctgtagcctaccaagcagtctccttgtcttcagtctctcacccacccatgcatattctacactgttaccagttatcttgctccagcagtaccctcttatctgtggtttcattttctgtttcagttacctgaggtgcagcacaataatacattttgagagagagagaccatattcacatgttttttttttttttttttttttgagaaagggtctcactctgttgcccaggctggagtgcagtggcatgatcttggctcactgcatccttgatctcccgggctcaagccatcctcccaccttagcctccagaatagctgggactacaggtgtgcaccaccatgcccagctaatttttgtatttttttgtagagatggggttttgccatgttgcccaggctggtctcaaagtcctgagctcaagcgatccgcctgccctggcctcttaaagtgctgagattacaggcgtgagccaccacgtccggtccacataattctattatagtatattgttataatttttctattttattagctattgttaatttcttactgtgcctaatttataaattaagtgttataggtttatatgcataggaaaaagcatactatatttagagtttcaaaactatccacagttttaggcatccactgggtgtcttggggcgtacctcctgtggataaagagagactactatatttccctcctcaaaacattcaaatggctccctgttgtcctttgtgatctcatccctgcctgcttctctagtttcatctccagcttcgttcttactggtacctgtcttctatctgcataggaacacttggcaattccttcatgccttattctttaatacctttaaatcaagcatgttctatttttttgagctggaatgccgttttcttctttagtgtgtccgccaagctcctaaatatccatcaagattaagcttcctgtcagtcttagaagaagctgtcctaggtaactccttccttcccatagcaccatgtttatagctctattgttatatttaacatattttattataataagtcatttatatgttctttttccacaatgtacacagcttctgtgttcaagaaactaggtctaacggggaagacagacaggtaaacagaataaagataggacctgaagatgcaatatggtaaaatggcaggccagcaggctatatgtagtgtatatatatatatatacacatatatatatatttcccagagtgttttgaaaaacagtataatgaggtacgtgttttgatccacaatgtaaactatttcatacccattgtcttatctgtgacctcctcacatttgagtttgcaaatcctgctataaagggaagaaactataggaattagcttctagaggaaatgattaggggtttgttctagagtttaggtgggatggttgtcttaaggaagaaatttttttgtttgtttttttttctgcaactaaagggaataagaaaacaatatgtaagatcactggtgaaaaccaggtacaaaagggcttttgcatcatggtctcaatcttcaacagatggagaggtttattcattgataaaaagggcaggtaggaaatttatagaggtgtttcaaaaagaaattctagaataatcactttaagtattgcatttgcccagagattacgtacattggtccaaaaatgagtgatacgaaagctagactgaaatccaacagatggaatatgtaatgaactaggaggtcggcatgggcctgttttgcgtttgtctaaccaatgttgattagaagcagaaatggaggcatttgaggccctcctgatcttgagctaccatcagtctttacttttcactatcctatataaattgtactttaaaagtcaagccaggaaactgcctgttacctgaacaaaaccacccccttagcctcaggcagtattgcttctgactttgctcaagggatcttttttgtatagaatgttttctttcctttgtcaacattctagccatcctccacagctcttccatgaagcctgtcttgatcttgatccgctctcccatttccacctacagtaatatatctgaactcctatagcactttatttttaactcttagggagtcactcttaactttatcttatagttcctatttctttatatattccttaagggctttcagaatactcctattttactttatgcctgtagtaatttatatccttaaataatactgtctcacatactatgagtctttgtatatccacgatacagactctatgaaggaaggcaaattttagtagcaatcatgggtttagaggcaaatggacctggtttcagattctgtctctgctatccaaggtcacatactagctgtgtgaccttggataatttacttctctgaatctcagtcttttcattgataaaatgaagagaataatactaaatttgtgatatttttgaagtatattgtttatgtttaatatatttaacatgtaaagaatcttgcaaatagtaggtctgaattacatttttgttaaatgtcttgaattctacaaaatgcttgatatgaaagacataaaacataaagactacatggtaaaatgagataagactgagctgccttttttgttgttgttcagtgttcaagatgtttgctatttgaagatttaaagggaaaaatgggatttattctgggtcaagaatggtgggaaggattcagctggatgctggaaggagaatgttttgcctgtttattggaagctatttgttatgtggtgtggattattgctgggctttgaggaaaaaagtaaaatcatatatgatctcaagttaatattgacaagattattttaaagatttaataaaatagttgaggatttggtatagatactgtctgtgatgggaaatgataaaatatctttctggtagatctctagaaatagcaaacagaatttggagtagggaagagataaaactgaattacttttttcaatggcttctcgttctaaataactgttgcagaattttgtgaagcaaaataaattgtttttattatttagtaacaatgcatgaaacagatttagaaaacagctaaaatgattgattttatttcactacaagccaggaataatttatccacaggtagaaaaataagcattcttctgtgacaaaaagtaagaattgatatgattacatatgatagttggaaaatagcaaacattgtaatgaccagaccttataattttaaataagaggtaatttaataagttggcagcagcaacggctttttgggaaagcatttgtctcgtcatcagaagagtctgagtttgaatcctgattcactactcattcattccctgtgagcttgtaaacctctctagactcagtttcattcctttcttgaacacaaagttactgggtacttattagtgccaggcattattccaggtgctggaatgatgaaccatacagataatgtcttcatggaacttacattcaagatggggaaacagacaatatgacacatataaaatataatgacaggtaagcgctattagagaaagcagagagtgatcagggtgtggtattttagataggcgagctctttgggcaaatgacatttgaaaggagacctgaatgaaaatgggaagagccatgcaaatatctagggaagagagaacatcaagtgcgaaggccttgaggcaggagtgtgcttggagtatctgaaggaatagcagaggtcactgtgcatggagtggggtgaacaagggaaagtatgggggtgtttaatcccaagagttagggtgactaaaaacatatgttaagcatagttagtgggttgttaatttggaaaggtaagttcaggtcattttaggagagatattttgaagaattgtcactttaatagccagccaggagccctggaagggtttgagccgtggaacgacaaaatccaaggtgtatttggggaagagaaaggtagcagtggaaattggagaggttagacataagggcaaggagatcaagttgggggttgttgctgtagtttaagtaataagggtgctgaactggagtgtggttagtaggaactaaatggaggatatagatgagagacagagactgtggaagtaaaatatcccagcctcagcaaatgattttaaaagggcagaagagatgtatgaatcaataatgactgaaatttcaagcatgggtgaccaaaatgacttgagcattcatagagtagtcagggacgagaccgagtttggagtaaaagaagattgagttcagttagatatgttaatcagggagaaattactagaatcacaatagcaggagtaaaggtatcaccatgcaagaacatttatttagctcttacagcattagcagtataattttataatttggttctctgtttcaaactactgcttttaccattttaaatgtactctctgtatattgctgctgagactatgttgctgatcattctaataacatttacctgcttaaaagctgaagcctgaatatctttactaggtattgaaggccaagtatacttgtagatgattcagtggaccaagacagagaagagtgaatcattttggtggcttgtagtatcatttaccagataaacaatctgacataaaattaagaggtcatatttgtaccttttgcaatgttcctaataatctcagtcaaaaaaacaagcccataatagtgaaggtcagatacaaatgcatgcttctttgccctaatggagcatgggaatcatgagcactaactgaatgactgttgcaagagttttctcaaaatagagccaaatgaactcccacccgccagccggccctcttccaggctgacaatgaaggtaatactgagagtaagtttctgttaaaagtataaacatggctgggcgccgtggctcacgcttgtaaccccagcactttgggaggctgaggtgggtggatcacttgaggtcaggagttcaagaccagcctggccaacatggtaaaacaccatttctactaaaactacaaaaattagctgggcctggtggcaggcccctgtaatcccagctactagggaggctgaggcaggagaattgcttgaacccgggaggcagaggttgcagtgagccgagatggtgccactgcaccccagcctgggtgacagagcgagactgtgtctcaaaaaaaaaaaaaaaggataaacatatgatcaggcttaaaataataaatttagtgttatctatgtattacttactataagctgcctgatagtaatatacctaaaataccaccaagtgtggcagcatgctttgtaggctgttaagctgctactacattaataaattgaagttttattagtttatttatagaatagtatttgataattacctcacgtaatattacacttgtgtcaggccaattatttgaatatgttctgtgaaaaaagattaaatcttatttttccttttttctcctttttataattgtgtagtccagaagggggagacaaaacattgattattggaggttgaagtagctgcttcgtgatgataaaacattgtgttcttgtattccaatttgatttttttaaatgggtttagaaattgtaggatagttgctactgtaaaatatttagttttatggtggtgataattttgttaaaaatctaaattcagtcagaataaaaataatgccattattttaaactagcatatataaaatagaaaaactcatttggtgatcagatgaaaataagacctgaaactatttaatgatggtatattataagtgatcttttaaaaatagcacaaacactattaaagtaccaatttcagtcttttctaatttcacattcattatatgcaacgagtagctactttcccatttcctaatgttttaacactgcaagctaacttgtacattatacttattttggataggggtatctgtatatgttttgaaaggttttgttatttgaatttcccttcatttttggaacactatcgtatcagttccttcccttcccgtgcattgtcataaattgcattatttcatcatgccagattaaattcattgttcaatgaatgctgaaatatagattatgaaatattaacaagtcatcttaccttgggcatttggaaatgtctaaaagacagcatgaatgttagtattatgtttagacatgtattttgaaaattgattatattaatatttatgaataggggtcattatgttttataatctatcctgatattagaaatgaaaagatgtatatttcatgtatgattttgcatcacaaattcattagctgtgcattttgattgtgatcatgttggatatttctattgaggatatttttctgtgtgtataatcaggtaaaagaatcaatttaaaatctgatgcttgatataagacatttaagactagtatagccattattttttgtactggattggtttattttactaacaatggaaaaaattttgatcatctatgtagaatgaggtaattatatgatgtctttttttgtgtgtttttgttgttaagtaatatagtctctacaatatatatcctttaaaagctctgtataaaatttgctgttgccattataaaacttaaagtggcataacagagggattttttttatgaggcaatgcttcctctatccagatagccttgtcggcaggggaaaaagaggaaacaatcagattacaatcaatgtttagaagttaccttaggctagatgtagttggctcatgcctgtaatcccagcactttaggagggtgagatgggaggatcacttgagcccaggagttcaagatcagcctgggcaacatggcaagaccctgtctctacaaaaaaataaaacaattagctgggtgtggtggcacactcctgtagtccaatctcctagggaggttgaggtaggagaatctcttgagcctggaagtcaaggctgcagtgagccgagatggcgccactgccctcaagcctgggtgacacagttgagaccctgtctcaaaaaaaaaaagttagcttagctactgtatataaaattttgggcccttttctcatatatttgattccatttttcattttagttaatcaagtttcttctgtctgtttatctgttcggaaaggactgtttggttgaacaaacattagttcctttgaataagtagaataagataatcttaaaaagaaaaaggccgccttagatttatgaagtgtttcagagtgtttaaagcccttcatgtatttcctcacttaagctacgtgttatatgtatttctgtaggttcgtgcatcagtttttcagaagacattgcctccatctccaaattcttggaggctagttagagtctggccttatcccatggagatttttttggctgaaagctatatggacagtcttttgagtagtttgtactgaccaaggtatttcctgtcagtggtccactgatattcataacatttaaaaatgatacatgatattcataacttgtattaatatctagtttatatgcttgtatgaaatgctttctgggtctgcattgctaaataatggtgatgtgaccagtgacatttagagtaattttttgtactgtggtcaccataattcggataccatgattattacattaattgcatgtgcttttatagttgcagccataattacctattaaaacaatatagaaaaaaatgaactttaacagcatcaaagatattaaaagcatttgggttcattttttatgctgatctgtttgtaaatttttagtaacctgtcatggttcttttctttaatgaatttgtgatctaaggagaaaataactgcttgtgcaatgtaactcttgtgcttggagaacataactgctttgtatatttctggtaaatcatttatttttattgatgattatgatgcttttttggcagagtgcttatccactcaaagagctgttctacgaagtgtgattggtgtctgtatccaagatataacatgtattctatgtgtttatatatgtctctctatatctatttatccatctttctgtctatcctcccaaagttaaatgagcttaaataggttgcctctgtgttagaaagcagagaagtattactagagaactgaggctcttccccaaaattatttcagattttcttattgtgtggagtggttttgcttggaatgagaaaagctatgtgttaccggctgaattgtttccccccccctcccgccctccccaaatttgtatgttgaaaccctaacatatcagaatgtgactgtgtttagagatagggcttttaaagtgttaagttaaaaaaaaaaagatgcctttagtgtgagccctaatccagtctgactggtgtcctggtaagaggacatttggacacacagagaggtgccagggttgtgtgcagacacagaggaaaggccatttgaagacagagagaaaagatgaccatctgtaagccaaggagggaggcctcagaagaaaccaaacttactgacactttggtcttggacttttaatgtcaagaatggggagaggggccgggtgatgtggctcatgcctgtaatcaccaacactttgggaggccgaggcaggcggatcacttgaggtcaggagtttgagaccagcctgggcagcgtggcaaaaccccatctctactaataatatcaaaattagctgggtgtggtggcacatgcctatagttccagctactcagcaggctggggcacgagaatcactggaaccaaggcagaggttgcagtgagctgagatcgcgcctctgcactccaacctgggcaacagagtaagactctgtctcaaaaaacaaacaaacaaaacacaaaacaaaacaaaaaaataaagggacaacaaatttacaaaaataaacaaaacaacaaatttctgttgtttgtgttccagtctgtggtattttattatggcagccctagcaaactaatacagtatgtaacagtcattttgttgtatttaacactgaataatagtgaacttttagagaacactaagtgccaagaaccgtgctaggcaagcttcatgtaaaacctaatttaatcctcataagaattatcacccccattttatagattaggaaagtgtggcttagaaaagtaggtacattgtttggggttacatagtaagtaagtgggagagctgggatttgaatccagtcaggctgacttcagagcttggcctcttaaccaataactaagtaagatttggtggatttcaggcagttgtggataataattgacaccacaggtgttcatcctctctaacactgttaatatttagtctttcaccatgtgctagtaggcaattcttattttctgccaactggagaatacctacagtcatacctacaacacagagagaaccttgcccatggaaaagctgctacattacagagaattaaagacctctgtgcacgtgttgctcaatgggccaaaaatgactctgccgatatggtctttgtggctttcatagcagatgttcacgaacaggtaacatcaatgcagataaaccatatactcagcaatttaaatgtgaggaaaaagatacataaatattagaaagaatcccatttttagcaatggcctataattctaagccatttttcctgtgtctgaaatagattaaccattgtgcctcttcgagttttttttctatctgtgtgttcacctttcttatgcacgcttgccttttataattaatttcaattaaacattagttttgtttaaataatactgtgtaattaaaatgcttatgtgctctcagagggcaaggaccatgtcttaatacactttagacatttttaaatacactaggctataacagcaataaaataattaaacatcgttttgttcaatctctacatattcacaattcctctgacactgaactgtgtataaactaaaatcagaaagctgctagttattttataatgcttctcaaaacagaagtcctcttccattggaaatgcagtctagcatcttaaaatctttttttttctttcaagaataaaactaaatttcttctattgtaatttaggtcccttgcctcttggtaagttttctatttctgctgaggaccgttgttcatcatcacccatgcaatctctcttagagtactcataggtttaagtggtccctcagctgctgcttctcccacttcctttaatttttccatataatactgccttctttttaattgcttttagagtgtctacagtttggggcctcagaagtggaaatgctacttgataatacacccaatctaaatgttcattcttattttactcaacgtgtgcttgtgtgtgtgtgtgtgtgtgtgtgtgtgtgtgtgtgtgtatacttcctcagttttggtggtgcctcttctattgatggtgattgttatttttttgttatacagatgtgactaaaattgagagttttttctccccgttctcttcgcattatctaggaaactccaaagatagctcttcatcataccaactagaaacatcttgagtgttcacctggagtttttctccagttgttttcgcttatagcttggtgtgcgaagttaatcatacccgtaggaaaaccaccacatgaaatggatgcttagagcgtacgttaaaacacagtgaaaatcataatatttgggctttgaagacctgggggtttaggtcatggctctctctcttaatggctaagtgattgggggtaaaacacactcaacctttctggagcctaagtctctttatctgtacttactctgtcatcctaatagagttactgaatactttgtaaactgtaaaacacagtacacatttaaatcattatagtaatcagttaaggaagtgattctcatggtaattcctaatatatatatttttgaagaatgtgttgatcacaactactgccaccttttagtgacacatacatcaatgcatttgttcctttattactcagtgttagtttagaagccagttatagttataaactttgtaaaagctgacgtcttctaaggtagcccctaggctacagactacatgtaaagttaccctttttatgaaaagccacaagcaactgtgaagattatccctaatcttccatctaaatatgaaaatatttgcattttaagctgcataaccatggtatccttttcttcttttcttttcttttctttctgtgtttttgagacagagtctcactctgtcacccaggctggagtgcagtggcgcaatccctgctcactgcaccctctgcctcctgggttcaagtgattctcttgtgtcagcctcctgagtagctgggactacaggtgtgcgccaccacacctggctaatttttgtatttttagtagagacggggtttcaccatatcggccaggctggtctcgaactcctgacctcaagtgatccgcctgccttggcctcccaacgtgctgggattacaggtgtgagtcaccatgcctggctgcttttcttatttcatttgaactcttttctccaggtatattatatatactgtataaatattattaaattaaatattattatatatagtatataaatttggggtttaatgactgtttctaaactaagatcacatgaactcagaaatggtaaagtagtactttgagatttgtggtagtaaagaatttgactttttttcctcctaagtttactaaatatttcaatacaaaagcccatatttccttaaaagatatgatgtaaaccaactatgcaatttaaagcaaatcatttttcaagtttgctattctcattataagaagagttcaatacattttagaaaatgtgagaatgcagttaaggagaaggaatcaaaacaattgcctataaactttacataaactattgttagtaatttggtatgtttatatttaatcgtttgtcagctgtgtagttaaacttttagaattctttctaccactttttgtagctatacttccctttcagaaatgaattcctattttattataaggtacactgatacagataattttggtagatgatagcttctaatagcaaagtagtattttaataaatcctggcaccctcacttcatttaattatagtctggttactggaaattcagtatctagaagcattttatgccttgaatagttgtggcataattttatctttagtcatgtttgagtatgtcagtagtcataggccatttttatgtgttttgctggatagctttaaaaacctaatgaaaaatgtttatgatttatccctttatcggattaaaattatacacaatttgctatcaagatgtaaaacaacagaatctcagttttctcagattagtaattataatgatacatttttcttatttttgagatgggaataatttggaaaaaatctagaggtgtagagtggatatgtagtactagaaacatatcaacaagtttcaggaaatcttgtaaacctctattttcattattttgggatgggggggttctattgaattaccattgcaaatgaagcaagatcttcatttggaaaatttacttgtattaaacagatgactgggctgaaatggctgctaaaacaatttcatgcttttgtttttaatgtagtccagttataaaatgtcacatcagattgtgtgtgagtacacaaatgcataattttaattttatttctgagttatcacattttaggaagttgattaaaatcacccagaattttttctaagctttttatatataacaaattaactatttgaaatgagttaaaacaagattgatattttggcagtaatacctttattaaagaaattgatcaattcttcagtagttacccattttgtccttttttaaattttattattattatactttaagttttagggtacatgtgcacagtgtgcaggtttgttacatatgtatacatgtgccatgttggtgtgctgcacccattaacttgtcatttagcattaggtatatctcctaatgctatccctcccccctccccccacctcacaacagtccccagtgtgtgatgttccccttcctgtgtccatgtgttctcattgttcaattcccacctatgagtgagaacatgtggtgtctggttttttgtccttgcgatagtttgctgagaatgatggtttccagctttatccatgtccctacaaaggacgtgaactcatcattttccattttgtccttttatttttgaatatgtaactcactgccaaattttatttgctctaatttcttattttagaaatgtcaagcctacagaatcattgtaagaatattacaatgaatagccatagacctttcacccatattttaaaattgttaacattatgttatatttgctttatcattctcttttaaaattttttttctttttttgccttttctgagccttagttgcctatttgtaacactttactcctaaatacttaagcatgtctctcttacgaacagggactttctcctatataaacatagtttaattactaaatcaggaaattcatcactattataatgttgttgcctaatatagagcccgtattcaaatttctccaactatcccaataatgccctttataacttcttgttttctagaatctaatcaaggattgcacattacatttatttgtcatatcttcctaatcttctgtagaacaagtcctagacttaaaaaaaaatttcatttcattaacattttcaagagaccaagacacttattttgcaaaatgtttctcagtggattggtttcattgtttccccatgattagattcagggtaaacattgtgggcaaggatgctacacaggtgatgttcttcctcagtacatcacatcaggaggcacagggatatcagtttgctccattattgatgatgttacatgtgatcatttggttggagaagtatcttccctatttgtctttgtaattaataagtgatatgtaggataatactttgagatcatgtaaataacctatttctctgaaacatttcacatggttttaaaatctgttgatgagattcttgcctgaatgaattataactaggattgctacaaaatagtgatttttctaattcattgttacttctgtatttatcatctggtattcttctgtaaagtagaactttcccttacctctttaaccttctttgactttttaaaagaaatatcagcatggactcacagattctttatttaaattcaattaactaccctaccttattgatagaaactctataaaatccattcaattgtttactgaaaataacacataaaataaagaaatcaaacaattaacatctgttggtttttactttatgaggtaactatacccatactaactcattaagtctcatctagaagcagttctacttttccccctagaagaaaacattagacaggtgcagtggaatttgaagtaatgaaatgtctgatgtgatacatttattcactgcatttgttatatttaggccttacttatattcattgctgcataatccttctgaatatcttaaacattaaaatctacttttctatcttatcagatacaagtcttacttcagattgctatttgaattagaatgcctttagccatcttcattttcaggcttccattgtttaaaaagtcatgatggcttatccttaactgttatcaagcatgaatctataaatacctacaaatgtgttttctaaaaacaaaaaaattatggtgtttacatatagaaatgtatgttgccatagtgttcaataatccagagcaatgcttttcagcctatcttccttgtaaaaagctgttcaccttaggcttttgtagcggtgctttgtaagttctacgtttttttccgattctgttttagaactctatttattttaaaaatttacaaaaatagcacccatgttcaaagacctcaaaattagtaacttgtaagaccagatgaattcatttttgtgtacaccccagaatgtagtttatctttgcatctttaatggcaaggtattctaagactgcaagagatgctattttaactgttaagatttgtagatacttatttgtgaaaatctggattttctttgtatgatacaactaaaacaaaatgtgtaaatcatctggatgttttgtttaataggactgtagctcttctataaaatgcctggtgttagatgttaatgtttattcaaatagtctcattgttcttttcgattaacttataaatcaatccccactaatggaacactactttaatatgcttgaaaaaatgtttagtcttggggaaaaaagctttaaaactactgatcttacagaaaatgtccatttcaatatgtaaatttagtatacccattatttaaaatgtgtgtgtgtgtgcgtgacacttttaaatgcatttgtatttgctatcatgggacattgaatcagggttttatttttttattttttgttttttatttttaattttgagatggagtcttgctctgttgcccaggctggagtgcagtggcacgatctaagctcactgcaacctctgccttctgggttcaagcgattctcctgcctcagcctcccaagtaactgggactataagtgtgtgccaccatgcctggctaatttttttgtatttttagtagagacggggtttcaccatgttagccaggatagtctcgatctcctgacctcgtgatccgcccgcctcagcctcccaaagtgctgggattacaggcgtgagccaccatgccctgtcgagtcaggattttaaaactagctctccctgatctttttttttttcgatgaagtctcgctttgcacccccaggctggagtgcagtggctcgatctcactcactgcaacctccgcctcctgggatcaagcaattctcctacctcagtgtcctgagtagctaggattataggcgcccaccaccacacccgactaatttttgtatttttagtagagacggggttttgccatgttggtcaagctggtctcaaactgccgacctcaggcgatctgcctgcctctggcctcccaaagtgctgggattacaggagtgagccaccgtgccgggcctctgatctttataaaaataagataaatggtgaaaattgggaattcttactgctcttatgtaaaaacaagaataattttagtggtctgaattgaagggtcatgagaagcagcaggtatactaagctgtaaatctgtgggactaaactataaatcgtggacaagtggtcaagcagcctttaggaaggcaacaatatcatggcaatactctatttctgagctgatgttagagtttgtattgtcaataagatcatggtaaagtttaaccacaagttttgcagcctttcatgtttcctccatactcgtggaatattacccttccaacacagacatttcccttttaatagagggttatccttattacctccaccacattcactatccattttatatccatatcttgatttctgcccttctaattagtctactttgagtaattaggataaagcatttctgaaatttcattatataagcattaattactgtctcttaggtctaaaataatttttcggtcacattttctaattgccaaaattattccttggatcgacattcatactatttttctacaaacattatattacataaataaaaagaaaaagtttatatatatatataagtattttatggatgaaggtaaaacatgagataatttccttatgtatggaacaactaatattaaattaattctttaaggttgtatttatagctctcttatgcaaggagaataacttaagcaaaatagtacaccagataactgttatgtggtaatagagagattgaattaacactaaaatgtgttaaaacacatatatttataaaatagacttaaatttcaagaaataaaattaatactgttgaaagaagtgtagaaatcatatagtgactttaaaagtacacaagttcccctcatttcaaaggtgtgaatcttttgtgacttttatactagtatttaatactatataaacctcactgtttattctaaatattttattttattttattttattgtagagacaatgtctcactatgtcactcaggctggagtgcaatggcacagtcttggtcactgcaacctccacctcctgggctcaagctgccctctcatctcagcctcctgagtagctgggactacaggtgcatgccaccacacccggccaattgttttgtatttttgtttgtttgtttgtttgtttgtttgttttgagacggagtctcgctctgtcacccaggctagatggggtgcagtggcgcgatctcggctcactgcaagctccgcctccggggttcacgccattctcctgcctcagcctcccgagtagctgggactacaggtgctcaccaccacacccggctaattttttgtatttttttagtagagacggggtttcaccgtgttataaccaggatggtcttgatctcctgacctcgtgatccgcccgcctcggcctcccaaagtgctgggattacaggcgtgagccaccgcgcccggccttgttttgtgtgttttgtagagatggggtttcgccatgttgcccaggctggtctccaactcctgggctcaagcgatctgccctcctccgcctcccaaagtactgaggttacagacatgagctgctactcctggccaatatttcttatttatttatttaaaatatttagtgagtgcttacagaacgtgccggctacttttctaggtactggggtgggggcagggagaaaaagacccctggggtatatagtctacttgggttagtgttagagtagaccattgataaatgtatttgttttgtaaggggatgggggaagccacattttctagttttcaatatacctttataaatggagcatttgctttgataaaattgcaattctgttaacgtctcttaaagtattttgtttctccacaagggattattcagtattaatcattcaatgcgtacgatcagtgaaatcttagcaggccaaggataactcttgtgatactcgtaaaacaaccagaacagataccactttacaaataaaggacggtgtggggatctactgtggtggttagaaaagccctgaatatctgatttgtgactaaaatgtggagagggaggggaagaaaaaagggagaacatgagggccagccagagttaaagaagactctggaattacatttttaattgttaagtcattggtttaacgacaagagaaaaaggcatgttctggctggtaactgacttcagaagcctagggcttcttggacagaagatacaaaggaaaaaactaagagaccaagaaggaagagagtgaacatgatcgttcatagtggtaacatcgatggcttgtagatattaaagccatcactggcagatgcaaactagagatggtggtaacaattttctgatggactttaggagtagtgaccaagctagttggatggagataaatgtaatgaagacatatgtagaagagctctttatttcagcaggtcaaggagtaaccaggcccaaagggcaaggtcacaaggcattgcctctgtgagttttcaacatgcagatgagtgatgtcaccagtttgagaagcctactcaccctcctcccagtcttgattctgaggacagatacttgtaacttgaaaaagttctctcccttcctcctttgggaatcactcctctattctgtgggttttctgactgtatagaaaaatctgctggtatcttaaaataactgctaaggatattgtgtgaatgtagaacctgtaacacacactgttcggtcatttggccctagttaccatccatctgcatctgaatatcccaggcatatctatagcagattgtaacatgttcagatcactgggaggtataatagtacattgtagacagacagagacatattttaacctaaaatcttaaaaatagatgcattggaatggatactctgatctccccagaatattttattttcctaaaatgcctcattcttttccgatctttaggtaaggaggtattttgctttatcaatctgctttccagctgtttgggatttaatattccacatagatgcatgcattttctttgtaaataatgacaaagacagattacataattacaggcataaaattatctcatcttgctaaaaataatacagtaacaggattagtatgtgtatcatctgtatgaattaaccatttatttttattaaaatactaagatccatattatgaccacccttatgtgttcattgtctacttgtttgaatcaagaaacattctggcctttgatttcttgtagttatagatatatggaattggtaatgttgattgaaatataacatagtccctttagcttcagtactttaggaaaaggttcctctgtccactataacatttctcaaacccatgtaaaaacagtagtgtaaatataagcatacacaattaaatgagtgaagtaaaactcattggtgtgactatcagggctttaaaaaagtgtgcagtttgaaaaaaaatgaaggtgattatatagtaaaacaaacatctgtctctttcctactatccctgcactatgtataggacttgcttaattagaaagaagaagacatgatggaatatggtccaaaagtttgaagaacagtgaggggcatcagggcctggatgataaagctggacttcagtggattctgtgttaactgtctagatactgaattattgtgtagtaaatcatcaatgcagagtggaaaccttggaaatgttggctggaccttgactacagttggagaatagcaatttctgtaaggctggctgaatcatagtcagatcatctcagaaaagatgagcagcagtggttaagaaggcaatctctggagtctgtctgcccaggtctgaatcgtggcaggctgtctaatcttgcttttctcatttataaaatgagatgacaaaaatagtatttatttccaaggtatgttgtgaggattaaatgtcagccattgctattgttgttgttaggaggggagttaaatggattttggttttggacagaaaaaatggatttggtttgtaaaagtaatcaaatataagcagaaatatctgctaagctattggagagactgaatagatactaggtgaaagggaagagtaagagttgttattttgtgagtccttgtttttgtttgtggttctatcacagaatacctgaggctgggtaatgtataaagaacagaaatgtattttctcacagttctggaggctaggaagtccaagatgaaggtgatggaatttcgtgagggctctcttgctgcatcctctggagggtgccacggacaatgccatgtcctcaacatggtgaaaggtggaagggtaaagagacaaaaggtggccaaacttgccttttttttttttttttttttttggagacagagtttcgctcttgttgcccaggcacgatcttggctcactgcaatctgcgctcgcctcctgggttcaagcgattctcctgcctcagcctcctgagtagctggcattacaggtgcctgccaccatgccctgctagttttttttttgtatttttagtagagatggggtttcatcatgttgcccaggctggtctcgaactcctgacctcaggtgatccacccgccttggcctcccaaagtgctgggattacaggcataagccaccactcccggccccgaatttgcccttatataatgggattagcctacccagtgggacatagcacccagagccgtatcacctcccaaagttcctacctcctaataccgccacaatggcaaccaaatttcaacatgagctttggaggggactaacattcaaactgtagcagtccttatataggagccacaacccaaaccttagaaaattttgagctccctggagcaaatggaagagcagaggagaatgtccttgaggactacagggaacaagtagatgagtagggtcaagtagaaactttcacaaggttaaggacacctgtgtatgtttgaaggtagagttggagaaaccaagggaggtaatccaaaatgtgattatacccacaggcccttttccacagaaaggtactgagagtcccctgttgccatcagtgaaactttacactattatgtagtattaaagttatttagtgcagtagtagtcaagaatttggcagctgaaatgagctaaatgcccccttgataacctgtgaagatgttactatcctactgtaagtgctcatctgattaccagggagtcatgaaggtactgtggagaaaggggcttcaggtaattagaacttggaagtagccatgtctgttgtgaagagctgggattgtaaacacattttgcaacagtataaaaactgataacaaatataatttagttattctaaatgtaattgttactacagcggagataacagatgtatttagatcagcttctgtttgtgtaaagaaaaatgtaaactattgattccaatttaatgagcactcacaatggttatagctgtgttatttacatagctatgtaacagaggaaacaaatacctagagaagataaatgagagaaccccaaactgaaacacctctcactgggctttactttcactgctgatgacactaatccttttactttactccagcaataatttaatgttttgttttgcatactagaatccttctagtattaggaagaattcaaaaggtaagggagaacccttgtcaatactatataggtaattgctagtaaattttcttttaatattgcctatgccaaattttagaaaatgtaataatcgaagctagtatgcaagcagtagcttctgtaataaaataactttatattatgtaccgtgatgtaaaccttattgcttgctttgatttatatgcaaatatttctttttcttatagtttatactgctttcagctgctatcttagtttttgtgctctagacagtctccattttttccgtgattaccacaataaaataggcaagcaggaaaaattatggctacttcctgtctaattttgtgtatttgtttcagtagcagtaccaatcttttaggcaaccagtgttgtcgatgccatgaatttacagtaaacctgtggaattcacgtatataaaacatagatgtcatgctggtgaattcaacttacaaggcatggaatagaactcttgcagtgaggctattagtttcaggtaatttaaatctcagtgggaaccaataaatggattttgaactaatatatttttgaagtcttcaaagataggagaagattgtaatattctgagtaaagaaaaaaatcatgggtgatttttttaaggtaaagaggtttaaatttaatgaagtgattaaaagtaatttcaagctttattttccctctataaacattgtttttagttgatttaaaggaaattggttaaaaaattaggcttcttttcaatataatgccaaatagaactaaacatatctttcaatgttgagaactttttctaatgggaggaatgtgaaatgacatatttctgaggacctacacagagcctaatgtaatttattcaccaatcccattgttgattaggatggtagacattactcttttctcttttttttttttttttttttttgagacagagtctcactctgtccctcagactggagtacagtggcatgatcttggcttactgcaacctccgcctcccgggttcaaacgattctcatgcctcagtctcctgagtagctgggattataggcacctgccactacgcccagctaatttttttcttttttttttttattttttatttttagtagagacgggtttctccatgttggccaggctggtctcgaactcctgacctcaggtgatctgcccaccttggcctcccaaaatgttgggattacagacataagccaccatgcccggccctagaaattagttttaaaggatattttacactagtttttcatcaggaaaagtatatcttgataaaatgtttttctaattttagaacttaaagggaaatgtataactacattaaagtataggtagtagtaataatcttatagctaattttaagactctgccactaaggtgttataattcttagctccttctcacacatttgttttctaacataaatgatgtgtaacggcagagatcatgagttacatgttcctcatttgccttgtcatatcacctagtgcaaacttctcacacctgtaacctggaatgataataatttatttacttctttgtctcttttaggacactgtgggatatttgaaggttagagcttggtttctatttctatgccagacaaatcttacatagggtttgatacttagttgttagccagtaaaaatctaggacggctcctacaagaaacatttaaagggtttggcaagacctagggccaaccacctcccaacccgtccccaccctccaaaatgttttgaggaaaattaacacccctattattattagggaagcatgcaaattgtgtaagtaaaattataagtcagagaaaatcgaaatgtccatgtggaatagttaacatctttttgtttctgttatttcagggactgtcatatccaagaggataatttgttactgtgtgcatgttctattagtactgtaagcccctttatacaaaggatgcgtttaatttttatattcccattatgtctgttacctagcattgccaagaatacaatagaggctcattaaaatcttgaatgtatgatcagtgtatgttgttgccagcacaccctcccaactctcccattagatgacaagcaatttgaggggagcacccaagtatttgtcatttttaaattcttctctctttcacactcaacacagtgccacaggtatagtaggcgtgtgtgttgaaggtttttaagagcattcccactttgggggatttgttagaaggactcacaggactcagaatatcatttcactaatggcgaagatttattacagtgacatagtagagatgcacagccagatcataggggaaaagatacaggcggagtttggaggaatctactggtgggctgccttatgctgtgtccctcccacgaggggtcacatagaacactcttttccttcagcagtgaaaatgcagcaatatatgtgtgatgcacctgcccaaggaagcccattagagagtcagtgcccaaggtttttattgggggccggttatgtagacacactctgtttagcatgtaccaagatttcagactccccaaagtaaagcagatattcaatatagactgcattgtttgtacaaacaggcatagtaaaccatccttatcagctaaggagcagtggggacactccccaaaatccaggttcccagataccagccaagggccaactttgcatgcaagcctttctataaatagcagtagtaggcttgctatgtccacttttctgcatagcatggctttgtatgaatactgctttaggcgggagaaggaaactgtatggcatttctttcagtacttagtcttaggctcaatttgttagggagattaaggtttcttttctttgttagaggtgcttctaatgtcttggttgttttaagtgcctgttcgtcgacttgcatcattgctgaattccttttttgaactttatgaatgtaccaaacatacctgatccccactcccccaactagagcttgaaagcttgctgaaagtacagggcttaaactccacgtctccttgcaaatacagtatctaggcatattctctgttgattcctggtttcaggtagttgtttgagttccatataatattatgttggcttttattcagatcgtgcaattttctttattttggttggtgggctggggtattcatagtgcaggacctaagaaagcagtaaagcaaagaaaaaagtgagaattccagaaaatctgggtatattattatagtatcacatgtcctaaaatgttcaaaatttaatttcttttttgttttttgtttttttttttttgagacagagtttcgctcttgttgcccaggctggagtgcaatggtgcgatcccggctcactgcaacctccgcctcctgggttctagtgattctcctgcctcagcctcctgagtagctgggattacaggcatgtgccaccacgcccagctaattttttgtatttttagtagagacagggtttctctatgttggtcaggctggtctcaaactcccaacctcaggtgatccgcctgcctcggcctcccaaagtgctggaattacaggcatgagccaccatgcctggcttcaaaatttaattgctgagctgtttagatgaatccctgatagcatctccatggtgattgttagaaaatcatctttgattactgcttcatgtgtttttctgtaataacacattttctgattgtaaaggtttctatcaattggtcattaccttgttgcttttggaagaacaattatggctgttttatattcaacagaggcccccttatcagaaacagtattgtcttcactttgcaaataattgcagtattgtcttcatttttgcaaataaagagggaaaaaaaatcctatgtatcttagagaattgtgggtgtcaactcaggttctcacccagttaattgtacgttttgaaaatttaaaaaaaatgaaagggctattgacagtgagatgtgacagctaacaggagaaggaggaactataaaaatatagtagtcttcagttgtttcacagagaggaaaacaggcccaggctcttcagtggttttggagggcagtgctgtatgattgcgcagaatagaaattgatcttgatgaggtattatcaagaggagattcaatgtactcctcatcagtgctgtctgtgtgtaatattttcaaaaagttttcatcgggaatggttagctttctccccccttttagttgttatacttaaagagatatctttgacgtacacagcacacattcatggatcactgattatgcctgataaaggactcattgtattttgctctctttatgaaaactcatggaaaaaaataggtatctataacttatttagcacttagtataatcaacaatgttatgggtacaacaacagagaactacaccaaatgaaagagggagtttccagaaatatttagtaaagtttggagcatgtttttcatgctcaccatttccccacattaatatttctgagattaatttccaaagaaaataattggtcaccaaatatattgttttaaaaaatgtttcatgtttttgctgaggcaaagaagtcttaacactttgtggagaaagggaaggcaattaatcattgaaataagataaaagatacttcagccacttgggaggctgaggcatgaggattgcttgaacccaggaattggaggctgcagggagctatgatcatgccactgtcccccagcttgggtgacagtgagactccttttttttttttttttgagactccttaaaaaaaaggattaaagatgcttgaaccttggtgccatcccatggggaggaaaaaacccctatttttcagatttctgcagtgcagttctttggctagctggtagttgtacttgattaagtagaagagggatgatgctggttttattacataatggtctatttctgtcctagcatgttcggtaggcaagcctccaataacgtttactgaccacttactgtgcttgccaggcaatgtgataaatgtttttttttggatgacctcatttaattctcaccgtaatcctttggggagatcatttttatctccagtttaggaggcggctgaaattcagagaagttaactaacttacccagggttagttgtgcctgatgctcaaccctgatgtcttaattgctatactgtgctgcttcctacccaaatgtgctctttgagtttcatgatatggtatttagtaggtttgccccagtctctacagggaaacagggaagattgtagacgtaagaatatacaagaaatgctaagtggctctttattcttctgagagtttctagtaggggaatttacctataataaatgaaatatagacctatcattccttacttttatgttccaaattgtgaaacagaatgttgttttatgatatttacagatctctatatggttttgtacagttatacttcctggattgttttgatactttcttacaagcagtccttgattgctccttttatagacggtttatgtaacctcctgaacaagaatgcatggccaccataatgctggagctctcctttgttgtttttagtgtcctagtgctaccaaagctggaatggtggtcctctgctcctgacaaacaactccattttcagggtttcctcttgcctccatccttccctgccagcagttgcaaggggattcagagcttagtacttttattattatgggagtatttttcaggatagctttactgcttaagcattttatttaaacttacttttcttgtgaaatatgtcccagagggttttattttttattttttgccaactgatttacaaatagactttagaatacaaaccacttataaattgggactgcttgtataacacatagaggtttgaggatactttttctatcagattagattgaatattcttattaatttgaatcctgtgataaatatgatattgtgtatgctgcagttagtttaacacttcagttgctataaaagcataatttcaatagtatgtaaatttaatgtaactttggagacttagagttggtttgttcattttgatgttaatttatttaaattttagatattttaaaataagtttgtgtaggcctggtaatgtattttattccaatgtcattatattttgaaattaaagttactttaaaataggctccaaggaggtgttagttaaattactagtaatgcatttggatgctctgaaaaaagtatacttgtcaaggaataaacataatgggatggcagtagaatccctttataatgctgctgttacatggacactatctgttatgaggactgattttgctatatcattttactatatagagtaataatttcaagagcaataagttttttaattttttattttttgagacagggtctcactctgtcgcccaggctagagtgcagtggcgtgacctcggctcactgtatcctctgtctcccgggttcaagcgattctcctgcctcagcctcctgagtagctgagtagctgggattacgggcatgcgccaccacacctggctaatttttgtatttttagtagagactgggtttcgccatgctggccagcgtcgtctccagctcctgatcacaggtgatctgcccacctcagcctcccacagtgctgggattacaggcacaagtgaccgtgcccggcccccttccactttttaaacaacagaaatgaaacttattaagtaggggccttcgatctggaggctgggaagtccaaggtctatgtgctagcatattccttttttggtgagggcccttttcctggctttcagactgttcccttctcactgtatcctcacatattaggaagaggaagctttggtgtttcttcctcttataagggtgctaatcctatctggggtttccaccctcatgatgtcatctaaacctaattacttcccaaagatcccacctcctaatacaatcacattgcaggttggacttcaacatttattttgcgggggacataaacatagtccataattggtgttttcataaaaagaccatatatcaaacagtagtgtggtgcacagtaaataagtgccatgggcgttcagattagagaaaaactattgaggtgagacagctagtaaggtagaaagacagacaatgtgttgttcatttatgtatctggcttaatctgttcaggctgctataacaaaataccatacgtggattagcttatacacaacagaaatttattgctcaaagttctggaggccaggaagtccaagatcaggatactaacagatttgatgtatggtgaggacttactctatgcttcatagatggcaccatcttacaaccttcttacctgacaaaaggggcaaacaagttcctttgggtctcattatgtggcactaattccattcatgaaggttccatcctcatgaaatagttgcctccccaacggccctaactcttaatactattacattgggattaggtttcaaaataaattttggggagacataaacattcagaccatagtagtattcttagtgccgagtacaatgcctgaaacaaagtaggcattcaagaaaggtatgctaaattgaagaattaaaaatcatggaaatagatattttgaattggcaggcatcttacaaatcaggtagtccaagttgcccagaccatttcaactccgctaggaacattaaaataacacaaagccattttacactcattaaattgccaaaaaaaaaaaaaaagtctgataataccagctctcattttctgctcatgagactgtaaataggtaaaatcatgttggagagcaaattggcatcattaactgaagttaaagataactctatcctgtgatataacaaatctcatttaatatacagactctagagaatgtctcacctatgtgattgattgtattagttttctggggctgccataacaaactaacataaactcggttgcttaaaagcttagaaattcattgtctcatagtcctggaacccagaaatctgaaattaaggtatcagcttccctccctgtgatggctctaagaaagaattcttccttacctctttcagctttggatggatccagagattccttggcttctggctgcataactccaatcttttcttccaaattcgtgtcatcttctgcttttcctagtgtaactcttctctgtatgtcttttataagtttatttgtcattggatttagagcccattcagataatctaggattgatctcattttgagatccttaattatatttgcaaagatcctttttccaagaaaagtcacattcacaggttccatgagtttgaatatggacattttttttggtggccaccattcaacccactatttcagcaaatatttaaagcagtggtctgtaccaaaactaactatgacctccctgtcatttgttctggtcttctagttccttgtaggtcacaggttatctcactgcaacttcagtaataaaaaaatttgagggaaaagtgatagtagctttatttcattacttatatatttcttgagactagttttatggcctggcatatagtctattctggttaatgttccaggttaatgttccagttatgcttgaaaaaaaaggtatagtctatatttggttaaagcatttcataaacatcatttagatcaagtcagttggtagtgatgttcaagtctcctatttttttaaaaactattttctgtctacttattctaccaattattgaagaggcacagcgaaatccccaattataattatggatttatctatttttagttctatcagtacatttgcttcttgatttttgaaacaccattattatatacacattgaagattatgtcttctttattaaatgatcattacataatcatagattgtacttctttatctttggtcatattcgttgtcctgactctgttgtgtaattatttacctactctagcttttttattattatgatttgtgtgatatatcattttgtatccttttacatttaacccatttttatctttatattaaagtgagtcaggtagacagcatatatttgggtaattttttaatgctttgtgaaaatgtctgccttttaattgatatggttaatgcatttacatttcatgcagtgggccctttgtgtctgcagttttcacatctggagacacaaccaacggagaaatagtggatgcagaacctgtggatatggagggctgaccatgagggacttgagcatgtgtggattttggtatccaagaggggtcctggaacaaagcccccatggatacctagggataactgtataattattaatatgactgtatttatttctaatttcctttttttgttttttatttttttatttttagttttgttttgttttgttttgttttgagacggagtctcactgtatcactcaggctggagtgcagtggcgtgatctcagctcactgtatcctctgtctcccgggttcaagtgattcccctgcctcagcctcccgagtagctgggattacaggtgcatgccactgcacctggctaatttttgtatttttagtagagacggggttgcaccatgttggctggaatggtctcaaactcctgacctcaggtgatccacctgcctgggcctcccaaagtgctgggattacaggcgtgagccaccacgctggcctcttatttgttttctatcctatctgtcctttgttcctttaactctttttttgccacatttggattgtgtgtcattttaactattccacttgatctcatgtattggcatattagatatggctctttgtttagttttcagtggttactatagaatttatattatgcatcttaacttatgacagtctagctttatatagtattgtatactttttctataagcaccttgcaatagcatccttatgtttgcacccccatcttttttattcttctcagacattttacttgtatatatgttataggtctgaccatacatcatattaattttttctttaaataatttgttttggggaaaaatagactgtaaacaatctcttatatattctcacactctatttcacacacatttctggcactcttcattcctttatgtagatctcagtttctatctgatattaattttctttagcctgaagaattttctttaagtatttcttatagtgcaggttttcttgcattggattttgcactgtatattttcagattatgtttgtctataaatgtatttatttcaccttcattttggaaagacattttcacaggttgcagatttctaagatgacagatttctctttttttttggtttgttttctttcagaaatttaaagatttcatccattgtcttctgagttccattttttttttcatttagaaaagacatttgggccaggtgcagtggctcacgcctgtaatcccagcactttgggaggccgaggcaggtggatcaccgggggtcaggaattcgagagtagcctgactaatatggtgaaaccccgtctctactaaaaatacaaaaattagcaaggcatggtagcacatgcctgtaatcccagctactagggaggctgaggcaggagaatcgcttgaactcgggagccagaggttgcagtgagcagagatcatgccactgcattccagcctgggcaacagagcaagactctgtctcaaaagaaaaaaataaaaagaggtttaattggctctgcagaatgtataagaagcatagatacttctgcttctgtgggggtcccaggaaactttcaatcatggcagaaggcaaaggagaagcaggtacttcttacatggaaggagcaggagcaagagacggagggggaggtgccacacactttaaaaaaatttacaacagtcttttttctttttcttcaatttttaagttaaagggtagatgtacaggatgtgcaggattgttacataggtaaatgtggagttgcattgtttttgataagaagtcaccaatcattttaaactctgttcccctctttgtaacatgtctgtctttctgactgctattaatattgttttatcattaggttttgacaaagtgattatgatgtacttttgaggtgtttttaatttttacaaatgtttatagtcagctctctgtatctgcatctgtggggtattggtgcaggaccccctgcaaataccaaattctgcagatactcaagtctcttacataaaatggtgtggtacatttggctctccatatctgcgggttttgatctgtagttggttgaatctgtggctgtgaaacctgcagatatagggagccgactgtatctcgtttgggattctttccgttcttaaattcgttggttagtagttttcatcaaatctggaaaattatgggccattatttcttcaactatttgttttgatctatcccttcaacattttggaaattttttctgtagtagatcactttatattgtccatatgtcactgaggctctgatagtttttttagcctttttttccctctctgtgcttcagattggtagttctttttaccattatcttaatttcactcatcttttctattgaagtgtctaatctgctggtaagccatacagtgaaaatttcatttcagatatggtatttttttcagttctcgagtctcatttgatttctttttttttgtagtttcatttctcttatttatgttaatgttttgctttatatcttgtatataatactaatatctgttttaaagtgcttacctgctattcccatcatctctgtcatgtctagatttatttccagtaagcaatctttttctgcttcttcaattacctagtaattttttgataggatgctagttattagaatgcgacattgttgaatgttggaatttggttgtcttaaaagagtattaggctttgttctagcaggtagttaacttacatgcaaatcaacttgatcatattaagacttgtttttaaactttgcatgaatctaaagtagcatttactctggatatggtttagtcctacttctaacatgtgtcctttttctgatttccaaatgctcaatgaagtctctcccctctgactgatcagaactcaaatgtctctcggtcctgtgtgatcttcagtgggtatttattcttctctggtagttcttctgatagttgttctgtgcccattctcgtggagtctcctctaaacttgtacggattgatattcagccagactcaactagactccactgcagatatctggaactgtttttttttttttctgtggggattcctcttctctggtaatgtgccctataaatccaagctgccactgccttcctgatctcccatctctcttttttcagttctgtaagcctgcagtactctgcatggtttgtcccctccctgcactgtaatgtgtacttccacacacaaaggctgggtggctatagggctcacttaatttgtttcctttctctcagggatcacagccctttgcagcctgttgcccaatgtctaaaaacagttgtttcatatattttgtctgattttctagttgtttacagatggaggtctagtctagtaccagttacttctttatggccagaagcagaaatctctaaatgtagcttttatagatggatgaggtgtgttcggttgtctttctttagttaataggcccttgaatttgtattcatttttatcttgggcactgcattttaaaagtaacctttcttggccgggcgcagtggctcacgcctataatcccagcactttgggaggctgaggcaggcggatcacgagcttagaagttcgagaccagcctggctagcatggtgaaaccccgtctctattaaaaatacaaaaattagccgggcatcgtggcgcgtgcctgtagacccagctactcgggaggccaaggcaggagaatcacttgaacccaggaggcagaggttgcagtgagctgagattgcgccattgcactccagcctgggtgacagagtgagactccatctcaaaaataaaataaaatgaaataaacctttcttaattctagaaaattttacatatattattatatataagattatatataaaatatataaattaccatgggttaatcctataagtttaatcagtaatgtagtgatccttgttgtttctacaaaataattcttatatgtgtgagagacatttacatgctgaattcgtaggtagtctgtttcaagtaaaagaaaaccattacaattgtgacctacttttttccatttgattttattcactaatagccatgtgttttgatagtgtataaagcaacattttattagtttctcaaatcccttgctatgctcttttgcagaatgaaatttttcactatttatgtcatactggagaatatagaatgtgaaaatataattgtccacttctcttaactgcaattatagtcgaatagtctcacaagatacatttttttttccccagatgtaagtgaagcctcttttgagttcagagctaaaattaaggactattttagattgagtccccaggacactcagtttttcattctaggtagcactatctcatttttacatttcctgtgttgtctctgtagatggttagaaaagcatacttcatcagaacgatgggttactgccagcacccctctgtgagatggttattaaaagcatgtcctttcctctccaattcagagtgcaaggttttcactgatgttatatacttgagctcttctgacacaagggagaggatagctaaaacagctctcaaagctgggtttatagcctttcctatcatttggcatttcactgaactaggtgaggtggttcttaatctttctctacctctctatcattaacatggttgatcgtcagtgagagctgcagtcaaacaaaaatggaaactttgtaatttatgtatagctttaaaaaggcaaagaaatgaaggattattgcagttggtgcaatccccgatacaattaatatcaaatgcatataaatcctattagagatctgtcatgggtgaaaaaggaatatgaaaaatgcgtgacctatctttattagattcagttagagagagaccatacagagctaaggagctttacgaactgcatattaatcataaccagtcttctgagataaacctatttcttgtaacttatcaaagccatacagaagattagtcattccctttggtaaaggaatgttttacatattgttctgagttttgaacatcacagctttaaaagctgattaacagatattttaatactaaaatatatctcattgaattatatagcttaggcagctattatcctgtaatgctacctcaatagggagatgggctctttgtcaaaacctctgcatcattgttttgttgcatattgaacaagacactctagggagttgtattagagaccagacaaaagaactttgctacagcaagcaatcattaaatcatgcagaaatatttctttcttaaatctttactttaagcaacaattggtagatgccagcaccattttttaaatgtcactttcaattcctgaagtcttttatctctttgagaaggaggggaattagcttaaggggacggttaagaccatcatgttaatacacggtattactaaagataggggatgtattaacagctctaatctgacaaagataattaagattgtattttaaaaatgtgagagagggtttcataagattatgaaacttttagataaaacataaagactaacaggtataaaatggattttgtattactgtctcacaaaacttagagatgttgagtgatataagcatttagtttctgacctcctgttaccacttcagtgcccagaatttatgtcatgtcaataaaaatacagaaccatctcatgatgaagatttctatacttgataatatataccattttatatatttgtttttatatttctaaaataataatcttgtttaaaaagctaaaaaatactgaagtatatgcattagaaataaaatctccccaccctacatggtagaggtactactattaataatttggtatataatccttctaaatattttttaaaatacatttattgaagggatacatacacagaaaagtacacaaaccataatattacagctcagtgagttatctcaaagtgaatgcacacatataaccaatacccagttcaagaaatagaacaatactgtctcttcccaattcctactgtccttgtcctccctaaagacttccagtaatttgacttggaacagtacagtttatttctgcctattttttgagttttacataaaataaatcacagagtatctacttctacctatctggcttctttcacccaatcccatgtttgtgagaatcattcacaggcctgagtataactatagttttaaattttgttcttctgtagctggggttgggcaccttattctaataagccgtaaatattttaggctttgtgggtcatatggtccctgacacagctttcgtaaaacaaaaacatcaatagatgatatgcaaatgaatgtgattttgctctattaaaactttatttgtaaaaataggcttcaggctagatttggcctatggactgtagtttgccatacatgcaataaataaatagaatactctagtatactgtagtatttcattgtatgaatatatcacaattagctgagccattcaaatattagcagacatttgtgtttttggtatgaatgcccttggaatgtggttttgtataaatatgcatgcatttctgtttggtatatggaattgcctcatgatagggtatatatatagggtaaacttaagtagtattgccaaatggttttccaaggtggttgtattagtcagcgttctccagagggacagaactaataggataggtgtatacatgaaggggagtttattaaggagtattgacccacatgatcacaaggtgaagtcccgcaataggccatctgcaagctgaggggcaaggaagccagtcggagtcccaaaacctttaaagtctggaagctgacagtgcggccttcagtctatggctgaaggcctgggggctgctggcaaatcactagtgtaagtgcaagagtccaaaagctgaagagcttggagtcttacattccagggcagggagcatccagcacaggagacagatgatggccggacgactccgccagtctactcattccaccttcctctgcctgcttctatcctagccacactggcagctgattagatggtgcccacccagattgagggtgggtctgcctctcccagtccactgactcaaatgttaatctcctttggcagcaccctcacagacacacccaggaacagtactttgcatccttcaatccaatcaagctgacactcaatattaaccatcataatggtagattaatttacacccctaccagtagttatactcatcatcacttgatattgtcaatcttattaaaagatgttttctttactaacttagattatacataataaatgataattttatttttaaaattaaagaatgagagaccctatatatcaatttatgtttgcctgctcagaaaaattcatacagaaaatctgatatgttagcccctaatttaaccaatatgttaaatcttaactagcctttaatcttaaaatgataaagaatctccacagcgtatattatgtaatttatatactgaactgattttcattctcaacagttgcctagtagtaacattagtgtagctatgcagaacaaagaaagaatacctaagccctagataacaatttctgcacacatactctattaatagcactttccaaaattatctacgatctttttcttagaactcaaatccaaagtccttttttcaaatgtaatcttcaaacttgttttggcatttgataccacctactacccattctttcataaaattcctgtgctggctgggtgcggtggctcacgcctgtaatcccagcactttgggaggctgaggcgggcagatcacaaggtcaggagtccgagactagcctgaccaacatggtgaaaccccgtctctactaaaaatacaaaaaattagccgggcacggtggcacgcgcctgtaatcccagctactcaggaggctgaggcaggagaatcgcttgaaccctgcaggcggaggttgcagtgaaccgagattgcgccactgcactccagcctaggtgaccgaaaaaaaaatttcctgtgctttctacttatctgtaccctgcttctctgttgtctgtgtcctagtatctcatctccctgaccggaataattttgtctgtttcctgagtttttgttcaaggctgtttgttcttctcctattaaaatttgcctggcatcttgagttcatattatcagccttatttggatgctcctaaatttacatcttcaatccagacttctcacctgcctaatggccttatattttcagatacctagaaggtatcaccttttatctcattttctcaaatttaaatatccaaagtaaaactcaaaatgttgatattcattttctctctctgcctctgccatcctctctaccaccctaaagtcccaacattccccattctccatttagcaaataaagatagtagaaagaagtgttttattaagcattgataagtagcaaaagatagaataatttctattgttggttaaatgaaagataagggaaggaatgacacattttatataacgcttattaggaaagaaatgtgctgtagtccaagtaatatgaaatattattaattttaatattcattcaccaaacaccaatcattttacagtgataatttgggatagttaggcaagttaattttggaaaatagtgcaaaagtagagctagatcattctaattgaacaatgataatagttcagttcttttagtgttccaaaaataaaataataaatatatgctaaaatttaaaaataatttattcagcataaataaatgataactatcatcttgaaaaagtaattgctctgggtagtaacaaaaagcctgtctttccagtgaggcactaatgtcctctgaatctaaatggagttattttcaaacttttgagaaaagcatataatttatcagggtgtcatttttaaatgtggaagcccttaatctcataaggaatgaggagagccactgaaattctttaatattctctaacatgcaaacaaaaagtagggtaatactgaggtgagttccctggtgataaccctggcaacttattagggtttaatataggcaaaataatgggaatgcctagatgttccaggcattattctagcagattatcagtacattctagtaggacagattaaaaaaatgtatgtattcatgcatacatccatatacatacacatatatatttatacacacacacacatacacacacatatatatacacatacatatataatcataggtgtaagtgctatcccgaaaagaaatagagcagagtaaggagtaccatggggtgggtgttgcaattttaagtaggatgatcagggtgggccttgtggagaatgtgatacttgagcaaagatgggaacaaggcaaggtagtgagccaagaagatatctggtatggttatatttagtaggtttttttttacttgtttctcactttactcctgaaaggattcagtgcctgcattatttaggtggtcaaaactaaataaaaacttgatatattaacattttattcctttggtaatatagggggaccatgctaaagagaacttagtccactctggggaagtgctacgtcaaacttttgtttgactgtcagagctctcactggggtacctaccatgctgccacggggtggagtatttcactgtaatgtttctataccttatgaaattgacttagattgaaaatatcccaccactttagcccctgagcctgattctttttaagtgcagattttctaatctaaaaatcaaataagagagaatatgagaaggttcaatggaaaatcctaggtaatgtatagctgtgtaacagtgactctttggaaacgtttcttctgatgttattatctattgagtggaataatgctgattatttctggttagataaaggggaaggcagataagaccttagggtagcccataaatcacatagtataggaaattaccttttccaattatgtagaagctgcccttgttgctgactttccccattattcaccatcactataattgggaaaaccagaaagcttggcaagagaaatttgaatagcgagctcttagtttgttatgttgctgctatcactggtataaacacaggtgtagttttacaggatgtttggtgattattctatgcagaaacctaatagtcgtgtcacaaatttctacctcagtatccagaatcctataatctgttttgggaattttccttttacttatatgtaattttacagataaatcctcagttttctagtatggcatttcaccactgatgctgaaattagaacattgagggcttgtaatttgaaaatgtaaagattagaaattatatttcatagtcgggtgtggtggctcatgcctgtaatcccagcactttgggaggctgaggtgggcagataacctgaggtcgggagtttgagaccagcctgactaacatggagaaaccctgtctctactaaaaatacaaaattagctgggagtggtggcgcatgcctgtaatctcagctacttgggaggctgaggcaggagaatcactgaaacctgggaggcggaggttgcagtgagctgagattgtgccattgcactccagcctgggcaacagtagtgaaactccatctcaaaaaaaaaaaaaaaaaagaaacaaagaaattatatttcatttgtcctgtctatatatgatccaatgtacttttgctttctggcttctggtttctgcattttttttttttttgagacggagtctcgctcggtcatccaggctggagtgcagtggcgtgagctcagctcactgcaagctccgcctcccgggttcacgccattctcctgcctcggcctcccgagtagctgggactacaggcgcccgacaccacgcccatctaattttttgtattttcttagtagagacggggtttcaccatgttagccagggtggtctcgatctcctgacctggggatccacccgcctcagcctcctgaagtgtagggattacaggcgtgagccaccgcgcctggccctggtttctgttaaactggacatgccactttaacattagctcattctttatttgcttagccaattatatacatttttacccttgcaacaaagaaggataggcatagatgttctggacttattgttgaaggagaatccaggttaataatctgactaggctagtggacaaatttaagtaaggaaaggaacatagttaactatcataggtctgatacacacgtttcagtgttaaagaggaatcactaatagtctattattcacagataaactgaggtacatgaaaatgttaaagagtttattttagcaaataaactcttgaatccagcaatcccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaaaaaaaaaaaaaaaaaaaaaaaaaaaaaaagtctccttgtgatccttaaaaaaagatttgagccctgtttgaggttgatcttttatatgaattaaaagtaattatatctcaaagaatcagtgtaaaatgtatgtattgtttggtttcatgaccctttgttattacttaccactctaccactgcagttcctaggtactttaattcagttgccatccttcccactctctctgagctccataatagtgctgatttaacaaatactcactaaatagacaaaaccctacttaccattaattatgaactgaaatgaagcataaatgtggaataaataaaggatataatgagaaaatgtacaaaatgcttcaaatgcaccagtacccattatatatcactctaaaaattaatcattatattaaagttatagtgacaaaatgttttttactaagcagaagtaaaatttttgtgcattctttctctatcccacctcatattttgaatatatctgcaaagctggtttaaatcttgcttaaaattttatgttaaaaaatgtatgcacatcacataaacatggtaatgctcaattgtccattaaggaagacatttcacattttcaacatgaatgcttttctattctaaacatttttattaagccatttattcaaccagaggcctgcacagtaagcaatagtgtagttgtttttcaactagtactctgtcaggaacttagatagaaataccacattgagaaaaaaagtctttaacagaaatctaaaaacaatcattggtgttggactgtaaaattagtttagagttggattttatgactttttaaggatactacctgtaagttcttttactatttttaccatttctcttaaattttcttctattgatggttgttttaaattacgtgatgccagagattgtatttgtatcctttttctccactcggaaatgctttttatactgccttgaatagtaccatgtatttatgtattttaaaggtgttttaagacatgcttggtaaagatgttattaattgcttatgcatatttcactgattgacatatacaataaaatagtaaattattaaactttttaaacacccagccacaaatattgtttccttgatattgcatgacaactttgcatagtgctctattaagtatttaatataaacaagatatctctctctccacccacttttcctctccgtcttctctccattgcaacttttctggaaacttcttcctagtccagtagtagctggaagagaattcctcttattccaaaaaagtaatctccctatttcaaagtacaaataaatcaatatgtttgcagatcccagcttcatattgtatggcggtctttaaaaaaaaaatgtggttaaaaaaaaaaaaacataacctgagatctaccctcttaagaattttttaagtgaatagtacaatattgttaacgacagatataatgttgtataacaaatctccagaacatttacatcttgcatgactgaaactttatgcccattgcaccacaactctttttttttctttctttctttctttttttttttaatcatactttaagttctagggtacatgtgcacaacgtgcaggtttgttacacaggtatacatgtgccatgttggtttgctgcacccattaactcatcatttacattaggtatttctcctaatgctatagctccccctgctccccaccccatgacaggccccagtgtgtgatgtgccccaccctgtgtccaagtgttctcattgttcaattcccacctatcagtgagaacatgcagtgtttggttttctgtccttgtgattgtttgctcagaatgatggtttccagcttcatccatgtccctgcaaagaagatgaactcatcattttttatggctgcatagtattccatggtgtatatgtgccacattttcttaatccaatctatcacagatggacatttgggttggttccaagtctttgctattgtgaatagtgccacaataaacatacatgtgcatgtgtctttatagtagcatgatttataatcctttgggtatatacccagtaatgggatggctgggtcaaatggtatttctagttctagatccttaaggaattgccacactgtcttccacaacggttgaactagtttacactcccatcaacagtgtaaaagtgttcctatttctccacatcctctctagcatctgttgtttcctgactttttaatgattgccgttctaactggtgtgagatggtatctcattgtggttttgatttgcatttctctgatgaccagtgatgatgagcattttttcatgtgtctgttggctgcataaatgtcttcttttgagaagtgtctgttcatatctttcacccactttttgatggggttgtttgtttttttcttgtaaatttgtttgagttctttgtagattctggatattaaccctttgtcagatgggtagattacaaaaattttctcccatcctgtaggttgcctgttcactctgatgggagtttcttttgctgtgcagaagctctttagtttaattagatcccatttgtcaattttggcttttgttgccattgcttttggtgttttagtcatgaggtccttgcccatgcctatgtcctgaatggtattgcctaggttttcttctagggtttttatggttttaggtctaacgtttaagtctttaatccatcttgaattaatttttgtataaggtgtaaggggggaatccagtttcagctttctacatatggctagccagttttcccagcaccatttattaaatagggaatcctttccccatttcttgtttttgtcaggtttgtcaaagatcagatggttgcagatgtgtggtgttatttctgaggcttctgttctgttccactggtctgtttctctgttttggtaccagtaccatgctgttttggttactgtagccttgtagtatagtttgaagtcaggtagtgtgatgcctccagctttgttcttttggcttaggattgtcttgacaatgtgggctcttttttggttccatatgaactttaaagtagtatttccaattctgtgaaaaaagtcattggtagcttgatggagatggctttgaatctataaattaccttgggcagtatggccattttcatgatattgattcttcctatccatgagcatggaatgttcttccatttctttgtgtcctcttttatttcattgagcggtggttggagttctccttgaagaggtccttcacatcccttgtaagttggattcctaggtattttattctctttgaagcaattgtgaatgggagttcactcatgatttggctctctgtttgtctgtttttggtatatagaaatgcttgtgatttttgtacattgattttgtatcctgagactttgctgaagttgcttatcagcttaaggagattttaggctgagacagtggggttttctaaatatacaatcatgtcatctgcaaacagggacaatttgatttcctcttttccttattgaataccctttatttctttctcctgcctaattgttgtcctggccagaacttccaacactatgttgaataggagtggtgagagagggcatccctgtcttgtgccagttttcaaagggaatgcttccagtttttgcccattcagtatgatattggctgtgggtttctcataaatagctcttatgattttgagatacattctgtcaatatctagtttattgagaggttttaggatgaagggctgttgaattttgtcaaaggtcttttctgcatgtattgagataaccatgtggtttttgtctttggttctgtttatatgctggattacgtttattgattttcgtatgttgaaccagccttgcatcccaggatgaagcccacttgatcatggtggataagctttttgatgtgcagctggattcggtttgccagtattttattgaggatttttgcatcgatgttcatcagggatattggtctaaaattctctttttttgttgtgtctctgccaggctttggtatcaggatgatgctggcgtcataaaatgagttagggaggattccctctgtttctattgattggaatagtttcagaaggaatggtaccagctcctccttgtacctctggtagaattcggctgtgaatccatctgatcctggactttttttggttggtaagctattaattattgcctcaatttcagagcctgttattggtctattcagggattcaacttcttcctggtttagtcttgggagggtgtatgtgttgaggaatttatccatttgttttagattttctagtttatttgcatagaggtgtttatagtattctctgattatagtttgtatttctgtgggattggtgctgatatcccctttatcattttttattgcatctattcaattcttctctcttttcttctttattagtcttgctagtggtctatcagttttgttgatcttttcaaaaaccatctcttggattcactgatttttttgaagggtattttgtgtctttatctccttcagttgtgttctgatcttagttatttcttgccctctgctagcttttgaatttgtttactctcgcttctctagttcttttaattgtgatattagggtgtcaattttagatctttcctgctttctcttgtgggcatttagtgctataaatttccctctacacactgcattaaatgtgtcatagagattctggtacactgtgtctttgttcttattggtttcaaagaacatctttttctctgccttcattttgttatgtacccagtagtcattcaggagcaggttgttcagtttccatgtagttgtgtggttttgagtgagtttcttaatcctgtgtcctaatttgattgcactgtggtcggagagacagtttgttgtgatttctgttcttttacatttgctgaggagtgctttacttccaactatgtggtcaattttggaataagtgtgatgtggtgctgagaagaatgtgtattctgttgatttggggtggagagttctgtagatgtctattaggtctgcttggtgcagagctgagtttaagtgctggatatccttgttaacctgctgtctcattgatctgtctaatgttgacaggggggtgttaaaatatcccattattattgtgtgggagtctaagtctctttgtaagtctctgaggactagctttatgaatgtgggtgctcctgtattgggcgcatatatatttaggatagttagctcttcttgttgaattgatccctttaccattatataatggccttctttgtctcttttgatctttgttggtttaaagtctgttttatcagagactaggattgcaactcctctttttttttttgctttccatttgcttggtagatcttcctctgtccctttattttaagcctatgtgtgtctctgcacgtgagatgggtttcctgaatacagcacactgatgggtcttgactctttatccaatttgccagtctgtgtcttttaattggagcatttagcccatttacatttaaggttattattgttatgtgtgaatttgatcctgtcattaagatgttaggtggttattttgcccattagttgatgcagtttcttcctaccatcgatggtctttacaatttggcatgtttttgcagtggctggtactggttgttcctttccatgcttagtgcttccttcaggagctcttgtaaggcaggcctggtggtgacaaaatccctcagcatttgcttgtctgtaaaggattttatttgtccttcacttatgaagcttagttcggctggatatgaaattctgggttgaaaattcttttctttaagacttttgaatattggccccctctctcttctgtcttgtaggatttctgctgaaagatccactgtcagtctgatgggcttccctttgtgggtaacccaacctttctctctggctgcccttagccttttttccttcatttcaaccttggtgaatctgacaattatgtgtcttggggttgctcttctcaaggagtatctttgtggtgttctctgtgtttcctgaatttgaatgttggcctgacttgctagtttggggaagttctcctggataatatccttcagagtgttttccaacttggttccattctccctgtcactttcaggtaccccaaacaaacgtagatttggtcttttcacatattcccatatttcttggaggctttgttcatttctttttactcttttttctctaaacttctcctctcgctttatttcattgatttgatcttcaatcactgataccctttcttccccttgatcgaatcatgtgttgaagcttgtgcacgcgtcacgtagttcttgtgccatggttttcagctccatcaggtcatttaaggtcttctctacactgtttattctagtcagccatttgtctaatcttttttctaggtttttagcttccttgcaatgggttcaaacatcttcctttagctcggagaagttggttattaccgaccttctgaagcctacttctgtcagctcgtcaaagtcattctccatccagttttgttccgttgctgtctaggagctgcaattccttgcaggagaagaagcgctctggtttttagaatttgcagcttttctgctctgatttcttctcatctttgtggttttatctacctttggtctttgaaatgggtgacctccagatggggttttggtgtggatatcctttttgttgatgttgatgctattcctttctttttgttagttttccttctaacagtcaggtccctcagatgcaggtctgttggtgtttgctggaggtccactgcacaccctgtttgcctgggtatcaccagcggagactgcagaacagccaatattgctgcctgatccttcgtctggaagctttgtcctggagggtcacccgcctgtattaggtgtcagttggcccctactcggagctgtctcccagttaggctacacgggggtcagggacccacttgaggaggcagtctgtctgttctcagagttcaaacctccgtgctgggagaaccactgctctcttcagagctgtcagacagggatgtttaagtctgtagaagtttctgctgccttttgttcagctatgccctgccccccgaggtgggggtctacagaggcagtgggccttgccgagctgcagtgggctctgcccagtttgagcttccccagccgctctgtttacctactcaagcctcagcaatggtggatgcctctccccctgccaggctgctgcctcgcaggtcgatctgtgctagcagtgagcaaggctccatggacgtgggacccaccgagccaggcgcgggatataatcttctcgtgtgctgtttgctaagaccattgggaaagcacagtatttgggccagagtgtcccgtttttttaggtatagtctgtcacagcttcccttggctaggaattggaaatccccctaccccttgcacttcccaggtgaggcgatgtcccgccctgcttcgtctcgccctccgtgggctgcacccactgcccaagcagtcccaatgagatgaaccaggtacctcagttagaaatgcagaaatcactgtcctctgtgtcgatcatgctgggagctgcagaccggagctgttcctattcggccatcttggagagctctctgtttttttcttttttttgagacagagtctctctgtcgccaggctggagtgcagtggcactatctgggttcactgcttcctcctcctcccacgttcaagcaattctcctgcctcagcctcccaagtagctgggactacaggtgcacgctgccacatccggctatttttttttgttgtattttagtggagacagggtttcaccacgttgcccaggctggtcttggaactcctgagctcaggcaatgcgcccaccttggcctccagtagtgctaggattacaggcgtgagccaccgcgcctggcctgaacaacaactcttgtatttctctctcaccccatcacctgtcgacaaccactttgagttttttttgatgagtttgactacttgaggtataaatggactcatgcagtatttgtccttaagtgactagcttattttaattaccataaagttagctatgttcactcatgctttagcatatgatagagcttccttattttttatgactcaataatattccaccgtatgtatgtatgtatgttttctttatccactcatccatctatggacatttagcttgttttctcctcttggctacaatgaataatgctgcaatgaacatgggagtgcagatatcatttggagatactgacataaattcttttggatcaatacctagaagtgggtataaggataaaagggtcaccatcttgctgttgtcattcccttatttgtctgtcttttgcatcagtatatgaagtaatagaaaattaattgaagaaggagagagatgcatatgaaaagatgctcaacatcattgatcatcagagaaatacatattaaaattacaatgaggtatcatctcacccaagttaaaatggcttttgtctaaaagacaggcaataacaaatgctggtgatgatatggagaaaagggaaccctcatgcactgttggtgggaatgtaaatcaatacaaccactatggaaagcagtttggatgttcctccaaaaatttaaaattgagctaccatatgatccagcagtcccactgctgggtatatacccaaaagaaaggaaatcagtatattgaagggatatgtgcactcctatgtttgttgaagcactatttacaatagtgaagatttggaagcaacataagtgttcatgaacagatgaatgcataaagaaaatgtggtacatatacacaatggagtactattcagccataaaaagaatgaaatcctgtcatttgcaacaacatggcaagaactggaggacattatgttaagtgaaataagccaggcacagatagacaaacttcccatgttctcacttatttgtgggagctaaaaaatcaaagcatttggactcaaggatatggagaatagaatgatgattatcagtggctgggaagcgtagtgatggggaagtggggatggttaatgtgtacaaaaaaatagaatgaataagacctagtatttgctagcacaatagggtggctatagtaaaaaataatttaattgtacattttaaaataactaaactaactaaacgtgtataattggattgtttgtaacacaaaagataaatgcttgaggggatagctaacccatttaccatgatgtgattattatgcactgcacgcccgtatcaccatatctcatgtagctcataaatatatacacctactatgtacccacagaaattaaaaattgaaaaataggcacacttccaggatcaaaaaaagaaggaaaaagatggcttaattattgtgagtttccaaatcatcagataaatatgccatatttaaatgcaaacaatgtcatattaactttttatatattggaggctattttctttcgggctgctataacaaagttatgttaatatgtcacccaccatagactgggtggcatatttaacaaaagaaatttatttctcacggttctggaggctggaagtctgagatcagagtgccaaggtggtcgggttctggtggtctgggttgcagactgctgacttctctttatattttcacatggtagaaggagggcgagagaactctctggggtccctaataggggcgctaattctattcatgaggtctctccacccttgtgacctcattacctctcaaagttccccccaatcacattgggggttaggatttcatcataaggatttgggggcacacaggcatttagcatttttgtaacaaaggaaaactatatactgtattcccctctgaaaattagtgaagtgtgttagctgttgaaacttctaagaagtctttggtttaactttctttcttttttttttttttgctttttttgagacggagtctcgctctgtcgcccaggctggagtgcagtggcgcgatctcggctcactgcaagctccgcctcggttcacgccattctcctgcctcagcctcccgagtagctgggacggcaggtgcccgccaaaacgcccggctaaattttttgtatttttagtagagacggggtttcaccgtgttggccgggatggtcacgatctcctgaccttgtgatcagcccacctcggcctcccaaagtgttgggattacaggtgtgagccgcggtgcctggtcagtttaactttctttaaacccagcatttcttaaatctctaggatgatgcaaaagtaattgtggtttttgccattaatggcaaaaccattacccagcaacctcttttggggttacccaggaacctcttttggggttgggggaatagtatccactaagtatccacttgtcttctgaggcaaggcactgcttttctactgcctacagttaggttagtgctgaatggtatatttaagtataaagtaaccccaggtcacatatggctacttaaatttaattaaaattgattaaaattattcagatcatcagtcacattagccacatttgaagtgctcagtagctgcaagtggctagcgactatttttattggacatatccataagaaagacacatattgggatccgttttgtcacctaacatccctacccccaaagaatttactgatttgttatttgtttttgtgattttacattaactgaataatgttacaaaactagtcttaaaaaaaatctgttgctgctttcaatataacaatgttgtatagcaatggtcccccaactttttggcaccagtggccgattttgtggaagacaattttaccacgggacgggcggggtgcggggatgtggggatcgttacaggatgtaattgttccacctcagatcatcaggcattagttagattctcataaggagtgcacaacctagatactttgcatgtgcagttcacaataggatttatgctcctatgagaatctaatgctggtctgacaggaggtggagctcagagagtaatgctcattggcccgctgctcacctcctgctgtgaggtatggttcctaacaagccacagtagtggtctgttgcccaagggttggggacccttgttgtagaggacagtgtgcactgttattgtgttttttgtatgaaaactcctatgagcccttttatttggttctaaaagttagaaaatcctttgcttctttgaaaagtaactgattatatttttatttccttttatttgggcaccagaaaacagttaaatctttgtcctaacattctttttaatctcattctattctgatttatatttttttctattcctgttttctctcgatatttgttttcatagttttgcaaaatacttcaaattccataagagcaaatcaggtataactgaacattagtgaattacagtcttttttcacaattcatcataagtggtcaacattcttggctgtccatttttgcagggcatttgatagttgagccatttttccattacaagtgtttctagtatcaatggttaagttttctgtattgtctgtaagctgtttcttgctcaggtatcttataatcaatagtacatgatacagaattcctgagaagtaggaatagaaaatctatttgtagtctgtgtttctccataaggctttagaagtagacgagactaagcagctttgtttctaattcagtatttggaacttattgtatattcattcatttactctttcatttattcattcattcagtaaatatttgttgaatgcctgctatgcactgagcacttttctgggtgctgaagatgtagcaagaagacaagaagacaaaaaaaattccctccctcaaggaactgacattttactgagattaagctcaaattccaattcattaaactcttaatttttgagatcattaaaagaaaagattgtctcttattggcatctcctctccacgtacaccgaaagttatttcatttccatggccttatttgctgtggcagtaagagagataaataggccaaatcgaactgggaggcaggaggaagaactcttgtccaactttcattgtattcaagaattcaagaatatgagtgagaaaaggctgataagaaatatagtttgttgatcctaggctgagtgcaatggctcacacctgtaatctcagcagtttgggaggccgaggcaggcggatcatttgaggccaggagttcgagaccagcctggccaatgtggcgaaatcccatctctactgaaaatacagaaattatttgggcatggcggtgcacgcctgtagtcccagctacttgggggaccgaggtggggggattgcttgagctagggaggcagaggttgtagtgagccaagactgtgccactgtactccagcctgggtgacagagcgagactctgtctcaaaaagagaaaagaaaaaaagaaatacagtttgttgatcctaaaatatttggagagcagatttatggtcaaaataagacatagtctctgagacctactctgttcttagaagtaatcaggaatatttatagttgattggttttcaaaacaaaaatgcaaagcagttaaatatatatttgctaaacttattgaacacttagtatatgacagtgttctgaatgctgaagatagatcaatgaacaaaacaacaaaactccctgccttggagcttgcagtaaagagtagaaaccatgagagcaagtaattgactaaggaagcaagacagtgagtgctgtggagagaaagtgctataaaaagaattaaaatggaaagatgtgatagtgatagactaacccctttatagcgatacttagaaaaggctttcctgatgtagtgatttgtaacctgaaacctgaatgatatgaagaaaccagccacatgaagatcaggaggaagacctttctaggctgagggaacagttaaactaaaagcctttaatattggaaagaacttggtctggtggcaaaacaataagaaagccagtttgggtaggaagtagtatgagcgccaagtgataggagaatcgatcacagagtgagggggaggccagatcaagtagagctgtttacttatgttaactgaactaaaactactatttgtctttaaagtaaaatgctttctgagtagccagtcctgagtactttccagctgctcataagccaaaagtcaatcacaatagtttaggcttcacttaaacacaggcaatctaatgttccattctttcatttcatttcattatttgttttatattctccttcactcttttttttctcctggtgaagcagcagaacccattgactttttgctgtactttggatttcagtctctgacttccttgcacatgtgcacacagaaggaaagagctgtgaaagagcttcagccaaggggttgggaagcaggagtccagaactttctagtttgctagatggatatgcagtcagtgatgatcacacccatgtctcactggtgattgattgaatcaaccatttaacatttttgaggttatttaaaaagttggaaataaagtgaaatctctaaagaatatactaatatttataattttgataatgaattttttttgttcttttaagttactttatggttgaaatgcagcttttcagtcttaaatctcatatcagtcaccttcccataattttaagactgcagtatttatttggttctattatataacttttatggcctttgaaagtaagagagtgaatgtaactgatagttttctgtcacttatactggtactggatctgacttttagctcttttaaaagttattttcactttggaaacactttaaagatgcattgaactctttttctacagctctataatccatttttatacacaagacatagtagcataaggctcccacatacaaggctcacaacaggcaaaattccatatgtctgcttcagatttgcctgctgaatacattgttgtggctgcttctaaaacattaaagacatacctgccaggttgtggatttttttttttgtcttgactttttgaaagtttctgcactattttttcttagattacatatagaatataaagtacagttaagtcctatgaaagatgagaatcttatagaccttctggccacaagaaaccatcaaatttacattaaactctacttctctgtattatcaatttctctcaataaaaatatgaaaataattattatggcatgatacagtaaaacacaggaatagtggatttagttccctgaatactgtattcctttcttccttcccttcctagtacccactggcttgctgttggattgtgcatgaaattaaaagaaacttgaatacattgtgccctggaattgtttgaatgaaagtgattgcattaattcaaaggtttggatgcctttaagcatacgttgtaaaatttttaactggagagataggtgaattttaaaaattagagacatttcaaatcagtaaaatgttactagagcagtagacaaagtggggggaaaagataaattgattccctatatcataccatttaccagaataagcttcagaacaatgagttataaatataaaaccatacacaaactaggcctgaatataggtaatatttacttgaaataagagcagctttgtgaaaataaaaacaaaagtagaagataaaagaatatatttttgactgtacacaaatgaagaacttttataaatcaagaacatagtatatactattaaagggcaaatgccgattttataacaattttagacaattttgataatggattaataactttatgagtattcttatatagcaacatgaaacatgtgtatcctaatagaaatatgaacaaaggtattgaacatagtattcataaaatataagttacatatatgatgtgcatggtgtatatggtatgtatgagtgggcttgtatgaatgtggatggctgtgcatatattcagcctaattagcaatagaagaaatgactattaaaagaatactgcagtttaatagacaaaaaggatctaaaataatgatctgatatgtgagggtgcagagaagcatgcactctcatttcatgatggttggtttgtagaatagtacaacctttctggagggcagtttagcagaatgaaacataagcaatgaaaatatttatattcatgcctagcaattccatttctagaaaattgtcctaatgaagcagatgtataaaaaatatatctgtagtattcacttcagaattatttctagttgtgaaaaattagagcataaatgcccaataataaaggaattttaaaataattgtatgataatttaaataatctatataattatatgggagatgtttatgatatagtaaatgataaagcagaatgtaaaagatatgtacagccaatagtatgaccccaattttctttaagaatatattgcacatgggaaaaatgattagaccaagtgataaaatatattaacagtacgtctctctatgtgagaaattatggtgatttttaaattttcttctcttgcattaactctgttttccaaatttttaacaatgaacttgtattagttgtgaaatgaggcaaaaggaaaaaatgataaaggagaaagggttcaattatattatctttattctctcagtgttgcaattaatgatagaattaataagccctatttttgccttgtttaccaactttgagtttagcaacaggaactatttgtattccattatgtttataaaagatggaaatatattttctgttttttcttggtggaaggggcaaagtaagccacagcaattcttttagttagcatttcttttagatattcaaaaggacaagtatgttatatactcttgatttgattaaaggaaaacatatataaagaaatataaaggtatatatataaataaagaaatatatatataaagaaagatgtataaagaaagaaaatagatatataaatatcttcacctttccctccacactctgatcattctagtcacatctggtcttaaactttagacaggacatcatattagtaatttattttcaccacatctgtaggggtcttttatttgtagattctatagtgataattaatttaatgggagttaacatttagaaatagatttgtagccaggttttgtgctcttttaatgggctgggaagctaaaaataacgccttgtaagggaaacaattgcaaacagatgaaatttaactgagcaccagacattcagagttgaagagcacacatgggggaaattgtatgtccttaaattatcaacttactggaaatgaaatgctttggtacagatgtgaagagtaaaacaaaaacaagtctggtagttggttacatcttcccgtctgctcttcgtattacaagtaggagtcccactgtccaagctcatgacactaagctcttaaaaaaaaaaaacaaataaatgctttacaatgtcagctttagataatatattcagaaagagatgataacatcatgtatagttgtaagggacaaatatgctagttcaatttatctacagatgttcattgggatgcttcccctcaaagtgtttttgattttctcaaaagaccaatctcaggagctatttaagaaaatgtcatttgatttgcatatgtaaacaatcaggtctatgaaccatatgattttatcccctaattatttatgtaagggtttaaagtgagcatacatcacctatcacaaacctatcctgcaaattagcaaatgcatacactaacaaagacaattgctctgcttagctatatctcttaaggtgagacatttaatcccttggtaagtggttgtttatatgtaactaaaataagcttttccctccttcaccagtattaatgtttttctttctttttttttttttcttttttgagacagagtctcactctgtccctgaggctggagtgcattggcgtgatctcagctctttgcaacctccgactcccaggttcaagtgattctcctgcctcagcctcccgagtagctgggattacaggcgcatgccaccacgcctggctaatttttgtatttttttttttttttagtacatatggggttttgctgtgttagccaggctgatcttgaactgctgacctcaagtgatccactggcctcggcctcccaaagtgctgtgattacaggcatgagccaccatgcctggccgtattaatgtttttctaatacttccttaatcagataaaaatttcaatttgaaaaacttgaaatattgatgtaaattgtttgattactacatgtgttttcttttttttttttttttttttactattttgctaaagaatatggttagttataagttgatactatgtatatcttcatggagatttttaagtaggtttttttattggccctgtttatatgtgtaggaaattatgctaaatcacaaaactggaaacaagagctatttcttgctgtgtaagtcagtttatcaaaaatctagatagctgtaataatctttttttccttgttacatgagaacattctgtattctctatcccttaataatgattattttaagttatacttgaatgttccactggcattttacacttattatatctaatatggactttgtaagttttcgttattacctactctagtcactcctcatctgccttctatgtagtccttattactgttaacatcatcattcactcagttaaacaaatctgggtaacctgtccctcattccttcactctattctccagggtcaaccactcctccttatctatcagttcctgagtagtttcctgaatcttcaccttcatcttctctacatcctatctctgaactcatcctccagaatgccttcagaattacttttataaagcttagtctcctctctaccacttttaaaaaatataattcttttaattttgtccagtgttcaaataaaacactcctagaaagagtatttcttcatgaattcctttttcttatatcactatttggctcatactttcactgcatttttgtaatccaagtccccctaacacaaaatgagcttaaaatatggttattttggccgggtgtggtggctcacgcctgtaatcccagcagtttgggaggccgaggtgggtggatcactcgaggacaggaattcgagaccagcctggccaaaatggtgaaaccccatttctactaaaaatacaaaaattagccaggcgtggtggtgcatacgtgtaatcccagctacttgggaggctgaggcaggagaatcgcttgaacccaggaggcagaggtggtagtgatctgagatcacgccactgcattctagcctgggcgacagaacaaggctctgtctttaaaaaaaaaaagaaatgtggttttaatggttaaagccattaaaaaacccttaattatataaagcaaataataattacaattaggacatcagagaaaaatgcactttactatcagttaccaatatgtgaattaccacccttttacgttatctgtgagagtcaaactgtataccaccatgtaagttgaatatgtgtacactttgccttggggaggagctctaggctgatgtttctaaatggtgaggaacacaccacacctgatttgtaaagtcagagaaggctagagctggaatcgatcatttagtccaaaaccctcttaaaattttttaaaatttattttatttttattttttagagatggtatcttgctatgttgcctaggctggacttaaacccctaggcccaagtggtcctcccatctcagcctcccaagtagctaggactataggcttatgccattgcacctggctcaacactctttttttaaagagggaaagggcagggtcttacccaaggttatatatctagttctagagctatattgctagttatagattacttaaatgtactatgtgaaatttaatgtttaaattatttggttgaaattattaaacatttgaaacacaattatttttaatgaagtgacaaatatgtattaagtttaaaatattttttgaaacacattcttgtacttgaacacattttcttgattaaatattggtataaagcaggaaatgatctattaaaacaaaacattcttagaaaacttagtagcagttactccatatcaatagttgagcctagattagatcataggtttaaagcatacttctgatattatctgttatctatctaacactttgaaatgatctgaatgtcttattgcaaaacacggggaagatattagctaaagatttaaagagaaaaagcaaaccaagggctggaaaatgattctctgagtagcaaattggcagagttaaggagtttattgcaaagaaaaaattattatgtctattatatagctattaaaccatagtccaggtgaagagagcatgttagattaaaaatagcattagcaccccaaaagatctggaaggctacttttcaaaggatagcaaaaccaattgtgttacagggacaaaccttacttagaccaataagttataatgcctttcaaactttttggtcttaggggccatttacactcttaaaatttttgaggaccctgaggaacttttttgtgtggttcatatctattgttattttctgatttgatttaaatctgagaaaattgtaaaacataagaacagtccatttgccgtcagagtgatgatgccattccaggtcatgaagcctctggaaaacaccactgtacacttgtgagaacacaggagtgaaacagacaaataacttttttttgttttggaccgagtttcactctgctgcccaggctggtgtgcagtggcgccatctcggcttgcagctgggactacaggtgcccactacctcgcccggctaattttttgtgtttttaatagacacgaggtttcactatgttgaccaggctggtatcaaactcctgacctcaggtgatccacccacctcggcctcctaaagtgccgggattacaggcgtgagccaccgcgcccagcctcaagtaacttttagtcttgttacaacaatagttttgaatttacatacacctctgacagggtcccaggaataccctggaatcctttgaccacattttgagagctgctgctcttctcacggaggtcagtgtatatggacccagtaaggacagcagtgaagcctgggacagggatgagaatgggcctgtattactagaattttgtcattttctcatctcctcttctcttaatggatcagctcattctctcctattggagagaggcttcttgatttggccgaagtcttagttatcagcagcaatgagagcaaacagactggctggacaacaatttctgtgtttcaatgccagtgcctagtgtgatgttatttgtcacatatgcatgtggaagatgtcttggccaaataactttgggaaattttgcatgctctacacctgtcccctccctttgaagaatcacaatgcacattaacatattaaattatctgaaatgtcctatggtagaaaaattaattacctttattgaactcactgtttccaaatcttaggtgatttcagagcatttatcatcatccatggatactagtgtctcacaaaagagtttagaaagttggatgttataaaatttttatttcatttttacattgtagaattttctactcccctttcaataccaggcaaatcgatgtgatttctgtgaataagtaagcaagccatatacatttatacaaatatgcatcatttgatggaaaggcagcacattgttgccagggaaaattgtatctaaatgatgtttagatttttgtttggaatataaatggatagataaatgaaattattccacttatacttttaaaatgccactgacggaagaaaaaaaaacccatattatctcaatatgtattgtcaaaaagtccttgataaaatttagcatgctttccgattataaaattaatacaataggacaagtacttatttccttaactggctctttcttgttattcaggtctcagcttaagtatcactttgtcaaagaaacctttcctaacttcctgcatgaagtagctcccactccctattgtattagtctgataaaactatatattgcaagccaaatggcactgttctgtttaatgctaaaacacttgaagaattcccatgtgaagagccagactaggatgttcacaatcactagtattttttaggcttttttccccattttttagagaggaagggggagtgtgtatctgccaatgcaattaaataagagagagaaggaaataaaaagatttagaaagatatatgtaattttttcacattatgtgactatctgataaagtatgtaaaaatcaatagcatttacatatatatatgtatatatatatatatatataaaacaaggcaaatgattgtgtgtgtgtggtttttttgtttgtttgtttttgagatggagtctcgctctgtcgcccaggctagattacaatggcactatcttggctcactgcaaccttcacctcctgggttcaagtgaatctcctgtctcagcctcctgaataagtgggattgcaggcgcctgccaagatgcccggctaattttttgtatttttggtaaagacatggtttcaccatgttggccaggctggtctcgaactcctgacctcaggccatccgcctgccttggcctctcaaattgctgggattataggcgggagctaccatgccaggcctaaatgattgataatggaataaaaagtcctatttagtatagtaataagagagagtcaatgacataccaatataatttcaacagaatttttctttttcttttttttttttaagaaattgacaacatgatgtgtatttttatctggaagtaaacatctgggaatagccaggaaaaaactggaacggaagtgcactgaaggggaactagttctaccaaatatatatataaaaaaaggttaaagttataggattaaaatagtttattcttgtttataacagagtcaaatagtagaccataatatatgcaggaatttactgtatgatagatgaggcatttgaattcagtaaagatcagttattcaatccaaaatttaatttgataaaaggatcataaagttaaatattacattacaggctaaaaaatatatttgcaacacatatggcaaagggctcattatcttaatatacaaagattttttacaaaataaatatgagtgggccaggcgtggtggctcacgcctgtaatcccagcactttgggaggccgaggcgggtggatcacgaggtcaggagatcgagaccatcctggctaacatggtgaaaccccgtctctactaaaaatacaaaaaattagccgggcatggtggcgggtgcctgtagtcccagctacttgggaggctgaggcaggagaatgacgtgaacccaggaggcggagcttgcagtgagccgagatcacgccactgcactctagcctgggcgacagagcgagactcagtctcaaaaaaaaaaaaaaaaaaaaaaaaaaatgagcaaatgaaaacccctattaaaaaagtggcagagcccctgaaaaggtagttcatagctacagaaatacaaataagcaataaaatgcatgaaaaaggatttaacttcaaacagaattaaataattggagatgaaatcagcaatgacataacatttgaaaaaaaaagtaacaaattaacaaagttttaaaatgttcgataatggtataagagagaatatggaaagaaagctcttccttctattgacacagtttttttcttttgtcatctttttggaggggcatttcgtgatatctaccaaaattgggcccagcagttccagttcttggcacgtatcctacacgtaatcctatacaaatatgtgaaggtacatgtaaaagaatatcagatgaaatattgcccctcagtgaaagactggtaaaatctgctgttactcttcccctggcttagtgtgctccaaccacagtagctttctatctctttatgggacatacccagtcttttccaccttaagacatttgtactagctattctttcctcttgggatgccttttccctaggttttttacgtgactttttttttcttgtcattcaggtctcagcttaagtatcatttcctcaaggaagcctttcctaacttcccactacaaagtagctcccatttcccatcatagtactctgttttattgtcatcatagtagctattactatttaatattgtcttctatgtttacgtattatctgtttctctagaatatggaaaggcagaataacttggtaattaaaagcattgactctgtagccatagctgggttcaaattttggctctgccatttacagtctgttggcacttggggacaattctaacttaatctctagtgctttcactttttaaaaaaaatctgtgcaactgtgattaagaatagaacctacctcacaaatttgtgataataaaatgaacttaacatttaaaacacagcactattgaggacatggtagacactcataaaatacttgtagatcaattgaattaaattatcatttattcatttaaaagaatattatgaaaccatctcagtgaatgaggtagatctgtatgttctgatatgaattttcttcaaaatgtagtgtgagtgaaaatagactgtgaaggtaacctcaaaatctgggtctttaaacaacagagactcatttcttgctcatgttacatatctattatgtgtcagtgagggtctctgtctcatgttgtcctcactagtgtcctgggctccaccatatggcgaaaggaagtagaatattcagagtggcattttagatgcttccatctagaagcactaccctccacttatcacattgcattggccaaaataagtcacatagccacacctaacttcaaggagtaggaaagtacgatcctactgtgaccttctaaggaggagaaccagaaatgttgatgaacagcaattattaatgagaatgtaataattgagaaaaaaggtacaaaagagtaggtataaagagagcctatttttcaaagatgtgtgtgtacttggatttatattataaaaatgtatggaacaatctgcaaaactaatagtggtctgctctgggaaatgggatatttactttttacattaaaccttttgtactatttgatatatttttcaatgtggacatatattacttccataactaaaaaaaaaattgtctcccaactgcctctcacatatactttgacaaagtgctattgcaaatactattacaactcagtaaacatgggatggcttatattgagagaaggaaactgattcacaatgagagaaaaggggcagaaatagataggttattttctgggtagagaagtacagagaggggctcctaaaagaccagtggcaatactaaagttctttataaactatctagtagagaggattgtgtggtagaaatttacaagctttctagtaacaaagtttcctgggtagttaagtgccagacagtaggggcagaccacaaaaatatttttatatcattttgtatttggatagaagaaacatattaaggataatatatttctgaatagatatcagtgataaatttgaagattctgaactattgcagaagactgggaaagttccctgaaagtctccatttttccatgatttcataaaagttgctgttggcaatgattccagggcttttcccaacttggaaattcttagttttcaaagtactttaaaagtaagatataaaattattttaagggaaaatgataagataatgttttatccaactctgcttgccaaattatttttagatatatatgaatatttgtgtatgatttgcgaacaatggaagaagtattgattttagataaaaatcacttctgttttagatttttgttatttgtagtgacaccagtgtgtgtgtgacaccaacacacacatacatacatacaacataattagatatatgtacacctaattagctcccttgtttttactttttttaaaattccttggaaatgcctactttttacaggggaggcacaaatatggaagttctgtatggaggcacagatttagctctaaagtatgtggaatggtaaattgaaaggattttggaattaaacatttattgaatcatctccaaagtagtataagatatttgtatacagaaaatgctgtgagagaatttgaagcaaaattttctattatccctaattgctctttgtaatatattttaaatattgatattaaatatttatttttaattagtgtgtatttaaaactatagttaaggtaggaaattatgatttagtgtattttaaatatgtatttttattcctttcctcagccttctgttaaaatgagttgcataatgcttacattttacataggaatgcaaacagtcctattttaagtctggtcagaatttttaaaggattaaattcaggtatttaaaaaaatcattacgtcattatataaagacaagtctagaaaaatcagatagattcacaggcctttttacttactcagtctcatgacttttctcaggggtttattttattttattttattttttgggactgagtctcactctatcacccaggctggagtgcagtggctcaatctcggctcacggtaacctctgcctcctgggttcaagtgattctcttgcctcagcctcccgagtagctgggactacaggtgtacaccaccatgtctggctaaattttgtatttttagtagagacaggacttcaccatgttgtccactagtctcgaactcttaatctcaagtgatctgcccacctcgctctcccaaagtgctgggattacaggtgtgagccaccaccacgcccggccaggggtttattaacatatatacatacaccatgagaacactatattttgtatctcacattcttgcatgatcatatttaagacaacaggatttgttcaacattcctagacacctagtatgtcaaggaatgtttctacataagtattatttattgaaataagctgcatttagactatgctactcaccatataaaggttgactatgcctaatccaaacatctgaaatctgcaatactccaaacctaaaatgaaatactcattagaatatttctgatttgggaattttgggttagtgatgctcaactggtgggtataaagcaaatattccagaatccaaaaaaatctgacatctgaagcagttctggtcccaagcatttctaacagggatacccacactggactcgggtggtaatctgcagcagctagtgaggtagcattcctgccaaacaatttgagatacattttgaagtatttggaaataggtgtcatattctccctttcctgagtttctagtaattataagcttttcacttcaatagttactcatgtataatcagtgagtttaagaaaattccagatatggtaattagatactaacacaatatggtgaaaaataggaactaatatacaaacttgcagattctttatatatttaatacagatggaagtccttgtttaaattttaatagtatgatacattaggagaaaaggacatatttggtaaatctatatcatatatagtgtcagattttacaggataacttgtaaggaagggatttatgagaaaaaaaatgttagcggggccaaacaatgtaaataaatacatgttggcaaatgtgctcaggagtattttgtaaggaaggagttataaacattgcctttaccttttgattgtatttgcaaaacaatgattcttaatggaaactaaaatttaaagtgttgagccatgagtgctcaactttcattgcatactctgtcataaagcatgctggaaagaaacaaaaacaagcctactagttgatcagttatttattgagtttttgttatttactcaacactacaattaagtgtggagaatacagaaagaaagtgtaacatatctttatttcagttaaaattttactgtttgacctgccgagagaggttaattggatagtcaaattggactttaaaggatcttcctgggagaagaccaacaagaacggaattttaaaaagtggcagtgaggaaactggctcaatccaaacacagggcatgtcctcagcaaataagggaataacaacaaaaccaacaacaataacaatggtgcttcacattaatcgaatacttattacctgctgaacactgttttgaagtgcctttagttcatgaactaatttaattctcacagtgcctccttccaaatagaggaaaaagagatctctcccctcttccatggctacctgggctgaccccaggagggcattaaaagcacctaaatattcttgggttggatggaaaatccttgtttgggattttaaagacctttccaaaagaggagtcaggggcattttgtaatcagctttcacctttccctaccctgtcaggcctaatgccaaatcggaaggaggagctttctatattttatacattgtaaacatttattgccttggaaatatattcttataagattttgttttagattttatgtttaaaggattttaaaaattgagtagagatttgcttttatcacaaagaatgctatttatgtacaaatgcagttatctgtttaactacaaaaaatgagttctctgtgttgtacatgggagggtgatgtccaagtatcacacttgaccaccagtctagttttaatctttttcttttacgttttttgaggcagagtctcactccagttgcccagactggagtgcagtgatgtgatcatggctcactgcagcctcaacttcccggactcaggtgattctcccatctcagccacccgagtagctgaaactatagatgcacgccaccacagctggctaattttttgtatttttagtagagacagggtttccccatgttgcccaggctgttctcaaactcctgggctcaagtgatctgcctgcctctggcctctgtcactgtgcctagccaagcatggaattttttttttttcataatttacataggtttttggagaacaggtggtgtttggttacatgtgtaagttctttagtggtgatttttagtcatttacccctcatccccctcccaccgtttctcctaagtctcttaaccacagaggtggtaagggccttgaaggctaggcaagaatttatggccaagtctttgccttataggattatataatctaatgatttagagaacttttgttatctagagtttaaggtactcataaaatgctgtttggttatagaatgaattttctcttgataaatgactgtactcaaaggcatattgatttccatataattatatagctagttatactctattttattagcaaaacagtcttgaattttgcataatttaatgaatataattaatgactaactattcttccttcctctgataggctaagtaatcaggctgacctagcccgattcattatactcattacagaatagaaaaaagaaaagctgcaaaatagtattttgcatgatggctctatttttctcagtttccaatcttagggacttgactaatttcattttaaagcagtacaggtatatatatatatatatatatatatatatatattttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcagcctcccaaagtgctgggattacaggcgtgagccaccgcgcccggcaggtatatatttaatacaaggaatagagacattctagccaaaatagtggtgaagtaaaattcacgtgtaaaatatccctttccttgcatgcttcaaagtaaagtggtgtcactggaaagatatacactggtgttttagatattagtttttaaaaatcatttaattattaggtaagggtgttttattttgtgaaatatggataaaaatctgaaatataagtcatattaggtaatgaccagttcccaaaggaaccttataaagagcttcatggatgaatgagtttacatctaataagatataaactcgctgataagtggctttctctctctctttctctgtctctctgtctgcctccttccctccctcccttcctccctccctctctctctctctctctctctctctctctgtgtgtgtgtgtgtgtgtgtgtgtgtgtgtgtagtactagtagtagtagagagcatagtcaaggaaataactacaagatgagatagtgaaaccttttgtttgatcaaaaaaagcaactctttgagcaattcagctccactggggcaggaactatgttttctttattcctccctctgtgcctagaattggtagatatttaaaagttttgattgtatcattgtaagtaaaagggggacttggattttggttataaaaacgtttatgccactttcaggaacagatatattgtatcataatgcgataattcttaattgaaatggcggcctttttgaactcttgtgggcacatcagaactattttactatatttagattgttcatgtgtggcttttggaacttatttcccatcgtgtaaatacagtgtattcatctgttgatcccctacttattaggcaccatgccgctactcttatagatgtcatcttatttaccagatatcttcagtatgtgtctgaaagcagatattttaatctcagtttttcaaattgggagatcgtgactcagaatttaagaatgctgcccagtaagttgcttggcagtaagctcttgggcttacatttgaactcaggttgtgtttgtcttgaatatccttgatggtcataaatctttatcttctaagaatggaaataatctttgaaaatagccaaaattttctcccttaaatttgatgaataagatgagtgactaaattgatcaaattctggccttaaaatataaagcaatgagacgtgttttattatttgggtggtaaactgtccctgaaggtaatttcttcagaatcaaaacagggatattcagcaatgttttcagcagtggcagcagaactatagtaagcatgtggcccctgagataactgtgatagtcaatacacattaggaagattaacttctgtttgttataaaacaaaacagaatagttattttatagtaacattttcatgatgccaaaataaatactttcatgtcattatctaattgtatacattgttttaagaaatgtaaagaaatactgtattagtacaaaattacaccatttatgttagtgtggaatgtttgatcattttatttctaagggaaaattacaaaactgtttagttcacctcagtttctataatgcagcctctaaagtctcatttctttaacagggccttgtgggtgttctaaaggaatgattgaaatgaaaagaaatgagagagtcaaacagtgtaccgtaatagatgaaatggaaagtaattatgttaatgttgactcattatgaagctctaaccatttttacctgctcatttctgtgtggaaacctgtgcagctgagatgctgaataagaaattcttgtacaaatgagcctagaggcatgtttctagtataggagctaggtctatgcagaattataatgaatttccctaagtcattatttaaatatgctatcagagtaggtgattctcctgccagaaaatttggcttctaatgtttatcatcaaatttttagatgtatatttgaatcttcattgctgcatgtaattctcatttgttaattagagagaaaaaaccctatattccacaatacatctatatcatatatagtgtcagattttacaggataacctgtaaggaagggatttatgagaaaaaaatgttagcagggccaaacaatgtaaataaaaacatgtaagtgcttaagaacgtgagatttggagtcagatgggctagattgaaaccaaatctgtctgactccaaaactgaagcttttattcatggtcagaaaattttgaaagtgtcactcccctaaatgcctataccattccccccattgcgcttaaatgtttctttttgccagtattctgtttctaaagcatgcatttttcagtcataatgtataataaagcttaatggtcttgcctcctatgactaaaatgtcctgccagtattctggaaataaaatattatagagaatctctctgattatgttaaattgctaacgatggcttaattacttgttagaaaaatggtacattgtcatttttaatttacagacacttaattttttcctatgctaataagtgacttctaaaacaattaaatccctgaaacaattaaatacctaatttttgttaaattatattcaacattaatttaagagtttaattaaagctaaagaacattttacctcgggcatgaactttttcccctttctgtcagatgtgaatgcttttaagtaataaacttaaatttcatgttcttaaaattaatgttggtgcttataatgttattttgtatttggtggtttttaatggcagtcttttatgtttggaatttcaatttttgtattatttcctacaaagatgcaagaactagttatactttacttttaacagtgaagtcttgatagcatagaattattacaccagaaggaatgtaaaaatttcatctagagcagagctgtctagaagaaatataatgcaaaccacatatgtaatttaaaattttctagaagccacatttaaaaagtaaaaagaaacaggtgaaattcattttaataatttattttatgtaatccaatatatttagtacattatcattttaatgtgtgatcaatataaaattaatgagatatatctttttattaactctccataatatgatgtgtattttacatttatagcacattttaattccaactagccacatttcaagtgattggttgccacatgtgactaatgacttccatattggacagtgcagatctagagtctcgatttatttcccatccctgtatccctgatgatatggcacactgtgaatagtgctattggcttatcaagtggtgcatacttccctagtaagggattattggaaaatccaggtgagaggagctgtcttctgtagttttggagagtaaatgcattcaatatgatcctgatcagcccataacctggggtaggggagcttacattctccactgggaatcactgatcttatttgacctctttatattctgcaagaggaaatgaggcccaccttcattccagggtccatgttctgcaataagcttggccctcttacatttctttctctcttgaagtagccttttcctgtgttgtttgttcattttgggatttttttttattattatttttgagacggagtctggctctgtcgcccaggctggggtgcagtggcgtgatctcggctcactgcaagctctgcctcctgggttcacgccattctcctgcctcagcctcctgagtagctgggactacagacgcccaccaccatgcccagctaatttttttttttgtatttttagtagagacggggtttcgctgtgttagccaggatggtctcgatctcctgaccttgtgatctgcccgcctcggcctcccaaagtgctgggattacaggcgtgagccaccgtgcccggcccattttgagatgttaatcagtttcccttctcttctagttttggatatctaatggaagattatcacatatcatgaatgatagttctgttgatgctatttctcttattaaatgttcattgccattatcttctttaaatctctaccatttaagtcacactgttgaagactcaactaatcagaaccaattgccttgcattttgaatgtgaactgcccatgaattctctggattgaaaaatattctccctcccctctattgattagtaatgtgttttttgttccttttcaacatatattctaaacgtttatagagtcctcttcactttcatgcttatgttatcctcttattaaataaagtaatgccaagcccatcatgtgagtgtttcttgggaattgagaaatttagaattgggaaaatagagaaagaactcagaaatcaaaggaacctggctcactgtgttcaatttgttcacatttcaacctcttaagtaatgaaatatcttctgaaataattgccttctcctctccattcccttcccacttccatatttttaggccacgacttttataagagcctctcagattgcactccttatgccttgaaagtgcatccagagttgtcattctaaaaataaatctaatcatgtgttcctttttgtctagcagtcatccagcatggcaagatccccagggttcttagaagcttggttccaaaacctacctttctaccagcactacctatcatttccttttgttctgctacccattccccactaaccagaacacccagcactctagcctgattgttattcataatttcccaatgcactgtaaactttctgtcatgcgtgtccctgtgaagagaccaccaaacagactttgtgtgagcaataaagctttttaatcacctaggtgcaggcgggctgaatccgaaaagagagtcagctaaaggagttaggggtggggcagttttataggatttgggtaggtagtggaaaattacagtcaaagggggttgttctcttgtgggcaggggcggggatcacaaggtgctcagtgggggagcttttgagccaggatgagccaggagaaggaatttcacaaggtagtgtcaccagttaaggcaggaaccggccattttaacttttgggattcttcagttatttcaggccatctggacgtatacatgcaggcttgggctcagaggcctgacactttcctgcctctgttcatgatgttcttcctttacagaatgccctccttccccaagctacactaaaggtccagtgccatttctgttggtgtaatgtccctccataaagagtaattagagttactcttttctttttattctcctaacacgttttcatttacaggtttcttgttttccactttgtgtggtaacttcatgtctcttgcttgtttgatagtaaactccttgagctggaaataaacgtagctggcatttattgaacatctaggtgctagacatcatgctaggtatgtttcctttatatttgcaactccagcatcagaatagtttatagtagatgtgcagtaaatatctgtggagttatatgtttgcatttttaaatatccattggaattcctttaggaatcctaacttagcatttccataggaggaggaaaatgccatgtataaaatacctactaggtgctttacaaatattatttcatttagtattgtcaataacactgcagttggagtatccccattttagagatgattaaatgaaactaagtaaagtggtctaattacccaactctttcacctagtaaatggcagaactatgatctgaatccaggtatgactgaagagtgtctccttagatttgaaagtacagatgtagagtaaagaaatatactttagtgggggtaggaggtaacagtctttgctaactagatcaattgattcatgcaaaatgggtattaaggtgcaggcatttccatctgatagcctttacttccttttcccaaggtgcactagtttagtcatgttacttaatgtttccattcacctgtgttggtgaatactaaattttgggaaggttattattggtaacatactgatacagtttggatgtgtgtccttgctcatctcatgttgaaatgtaattcccattgttggaggtggggcctggtgggatgtgattggatcatgggagcgtttttctcatgaatggtttaccaccaccgccctggtactgtccttgagatactgagttctgtgagagctggttgtttaaaagtgtgtagcactctccgtgccttactctttctccatgtgacatgcaagctcctggttcgccttccaccatgattgtaagcttccagaggcctcccagaagtagatgccagtgctttatttccagtacagcccgcagaactgtgagccaattaaacatcttttcttataaattacccagttttaggtatttctttatagcaatgcaagactgacctaatacatgtacacatgtgaaatttcagttagtaagacatgactgtggaagggaaaactcttctaagttagtaaaaagtctgaattataggaccttttcttgaaagtagagtggtcgggagtaggccagcatcattgctagcataggactgttgtaggaaaagctgggttcttgtcacatgaccaggaaaggttagactcacagatacttggaagggcaagacaaatggaatttatggggcgaaaaaagaaaaagaaaaaaactttaagcagtgcacttaggaagcctgttaactactctcgccccactacacaggaattcaagagcccagctcctccctgcggcaaaaggcaggaacttccttggctcaaccctgctctcccagtatgcatgctggtggaagattatccgtggaccctccccgttatctgcctcctgcatctatcaggaccttaggaagcctgttttactgaatgtatgaaagcttttagtaattagcatatcaattatttgtccataagaaggggcttcacaagtacttgagggcatttgaaaaggagtagaaaactagcataaattgagtggcataatttatgaaatcctcaccctatgtggtaggttaccagagatttgtaaatagaggctctaagaggttaaatcatttgcttaaattacaaagtaaataagtggcggaatagcatccaaatatacatttttctgacttccccaatgcacatactctttcagatatgctaaaatgtaatttcaatattttctctgtaatatttgatactccattaatttcattaacaagcatatttcataagtagtacaaagatgaatttcaaaatagctctagcaataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaagtatttagaaagtcttattgatgaggtaccatttccatattcaaaagacagggatctgttaaccttttagtgaatgagacaattcataatttttccttgtttctgtctctgttaatcctaacacacaattactctatgtagggaagcaggaaactccatttacaatgattatttggggttaatttcatttaatggcattcttgacaaagatatgaatatggcaagaatatttttatattttacgtttaacctttgtaatttaatctttctaatttcatttgatataaagcgtaaatgaaagcaaaaacaccatttatagttgagtgtgaatttttttctttttttgaaaccagtctcactctgttactcaggctggagtgcagtggcatgatcttggctcactgcaacctccgactcctgggttcaagcgattcacctgcctcaacctcctgagtagctgggattacaggcacatgccaccacgcccagttaatttttgtattttttatttattttttattttttagcagagacagggttttaccatattggtcaggctggtctcgaactcctgacctcaggtgatccacccgtctcggcctcccaaccaaagtgttgggattacaggtgtgagcagctgcctccggccgagcaatacatttctttgtgtctctgcattagcgttatacttttttttttttttttatattgagagggagtttcgctcttgttgcccaggctggagtgcaatggtgcaatcttggctcactgcaacctccgccttctgggttcaaacaattctcctgcctcagcctccggagcaactgggattacaggcatgtaccaccacgcccggctaattttgtatttttagcagagacggggtttcaccgtgttagccaggctggtctcaaactcctgacctcaggtgatccgcccccacttggcctcccaaagtgctgggattataggcatgagccactgctcctggcctagtgttatactttaaatatttttatttgaatacctataattatgaaacctgcaatattaagcatagttaaactttcaaataaagcaaatgtataaatatatccaattctattcatattcacttagtccactttctcatttcacacatttaacaaagcaagcaatgataaaatatgcatgtcttgagtattataatttgcatttgaaactgcagaatcttctggctgaatgaatcaataatgcaaatatctttctaattagatatttagtgttttttagttgtattttgtaaaatctaaagttttgtgtacaaaatagtttttttttttttttttaaagaaatctgacagatcttttggtcctgtgtttcaaagtacattgtgaattttgactgaaatcacagttgtctttggtataccaaaattaagttctgcatagtacctattttagtgttacagtcagtgtaactgctggaatattcaggtctagtggaatcagtaattatgtaagcctttcttgttagaggatttcttggcttagatacatcccttatatgtgcattgccccttattgccttattgtcattctaattactaccactcctttgtccccatccccaccccatggccttcattctttgttgctatctttgtgagtagaaagacaaactataaggaaaacttgtatgtgagctgtgtggggggagcgggtgagttacagttatttctaatatctaaagagttgtgtagaagaattagacttgcttgatgaaggcacaaaaggaataagtagaaccaaggaataagttgctgtgataaaggcatgaaataattgataacccaagatgcctcgatttggacctgctgccttaagagatactgagttgaatgttaaggcagtgaagtgcaatggaaggaatctgtgagcttggaaccaggcagacctgtatttcaattttgggtctacttcttaaataatagctgtgtggtcatgagcaagtcactaagtgacagaaccttggtttctttatttctaaactgggagatgatgcttaccttgcaggttgttgtaaaaactaagacatgatgtgagtaaagccccttggcacagtgcctgtcatgtaataggtctgtctattattgttgttttattcattttttgagtgatcaaaggttgctctttaaaaaaaaaaaacaactctaggtttagtggtacatgtgcaagtttgttatataggtaaattgcatgttgagggatctggtatacagattattttgccacccaggtaataagcagaggacctgataggtagtttttgatcctcaccctcctcctacctgccaacctcaagtaggcccccttgtctgttgttcccttccttgtgtcaaagaccactctttagaaatgatgttgaaagattgtacaaggtagtgaactaatataatttgtattatcccgtttatcttgttgatatgattctatattacttttaaagatatatggttgactggtaatgagcattatccccttctcttgttattggtatactgactaggttagtaattcatttttatttttatctttaaaaattattattattattttttttagagacaaggtattgctctgttgcccaggtcagagtgcaatggcgcaatcatagctcactacagcctctacctcctgggcttgagggatcctgccatctcagcctcctgaatagccaggagaataggtgcacaacaccacaaccaggcaatttaaaaaatttttttgtagagttggggtctcgctttgttgccaggctgatcttgaactcctggcttcaagcaatcctcccgccatggcctcccaaagtgctgggattacaggcatgagctgttgtgcctggccaaggttagtaattcatggagagaaaatgggattgatgctttgctttccagacttccacaggctttttaagtgaaaatgcaagttgacatatgggaattttaaaattatcattttgttattgattgctatgccaaccaatactcttttgtttgtttcttcccttactaatttaagctatttgacctggaactatagttcatgtagatcttgtgggcattttccaagtcgttatttctacaatgcctattaatatgtgtcttctatatcaagcaatggcactttttttgttgaataaatggatacaggggttgagctgttcataatttgatgcattttcaggctgttgtaagtgaattgaccatttgctcaaaatcagtgaacattaagctattaaagtaattttcatgtctgcattactgatgttttttttggaaaaagtatgaaattgaggaggatcatgataaaatgcatttatctttattctgcctttttgaagagaatcttaaagggcacaagcctgttggcagagatattcttaagtgataaatgataatgacaagagtggcgatggttttttccatcacagttttggggatcaaggtgagtcagagagaatgatatcctaaaccttagcttcttcattaaatgacaacaaaactgtcatttgctgatttttggccatcagaagtattatctagatcatattatctatttataactttgggataatgggtttctgattttatgtaatgtacttctcagcccttttatttatttttttatatagctttgattctttgaagctggtatgtgaagcacaagctttatttatttacttatttagagacagagtctcgctctgttgcccaggctggagtgcaatggccggatcttggcttactgcaacctccgcctcccaggttcaggcaattctcctgtctcagcctcccaagtagctgggattacaggcatgtgccaccacgcccggataatttttatatttttagtagagatggggtttcgccacgttgaccaggctgatcttgaactcttgacctcaggtgatccacccagcttggcttcccaaagtgctgggattacaggcttgaggcaatgtgcctggccgagcattattttcaaagtgtgctcaactggagtgcttctttctcctaggatgcccactatttgtgtagggccaatacttaatgattgttttttcatgattgctattaaagatactatttttgttacccaccctgatgctcgtgcttcacataacagcttcaaagaatcagcgagcatttggaaatgtataaaatgactcctgtcttttgtcaggagtagaatatactgataaaatcctttctcatgaatgatgaagttgccagaaatttggaatacttttggactgacaacaattacatgataaaatattgtgaaaactatttgtgaataaataatgaaccaatactacttctgttcactcagaacaaacataatacagtggttcagaagagcgtagtaaccttcatattgcttaatagttcagtaaacttttaatgcctctgaaaatgcataatagttccttaagaaagcatggtaggataatcagaaaagactttttttttttaatttgacaccaaagggattcatatatgacatctgttcattttttccacttcccttcttctagtaaaatacctagaaataattattcctagagaccatgtgatatttccacctttagtgtctagcctgcaattatttcaacaaagtcctcttggtacagtaaatagtaaaccccactggaccaaatcctaatagtatagtattggctgccatagtgtaacacacatggtatgtttacattaaattggtctcatgtcttaaaaagcatttgtctttatatttagtatagatacaatctagagatagattaactggctagatgatgatgataataataatagctaatctttattgagcacttactatgtggcaaacattgttctaagtgtcttatgtgtcttaattcacttgttataacatcccaaatgaagtacgtagtgtttttattccactttatagagacctaaactgaggcacagggatttaagcaactttcccaagattacacagctagttaagtggatgtaatccaggtaatttgattcaagggtccattctcataaccattatgtgatactgcttcatagccattgtgtgagactttaagagatgctgcagtgctttctcctttttcactacttcactatttctcgttcatagccctttgttcacagggaaaacataggaagggaaaaactagaagctccttgagtttcacctgtttattccagatttttatctcgtggtgtctcccattgtataaactgagatcagtaagaactgttattatgccatatgtttctaatcatagcaattgcttcattctctgaggcatacaacacatgaaattattgtcagacatactgattttatacgtttacaaatgctcgtttaaatagccattgaaatacaaacttcagtaaagagagtaatgtttggtttgcatgatgtctgaattctaagatttggcaatggagtaaagattttgcctagatcttatctttttccccccattctacagtgaggtacaatgataattgttatcatagtgatgaccctgggagagcattaacatcttttgttccctagaatgtacttattgaagcaggaatgtggatgattatgtttatgtttgattttgtttgtttttgagacagggtcttgccctgtcacccaggctggagtacagtggtaccatctgggcgcactgcaacctctgcctcccaggtttaagcaatcctgacacctcagcttctggagtagctgggactacaggcgcatgccaccatgccaggctaattttttgtatttttggtagagacggggttgcgtcacgttgcccaggctggtcttgaactcctgaactcaagtgatctgcccgccttggccccccaaagtgctgggattacaggcgtgagccaccttgcctggccggttgcttatgttttagatgtacagttgtccttaggtgtctgtggggaattggttccagaaccacccccccttgccaaatcccttatataacatggtatagtatttgcatataacctgtgcacatcttcttgtatactttgaattatttctagattacttataataccaaatacaatgtaagtgctatgtgattagcagctatactgtattgtctagggaataatgacaaggaaaagagtctgtatatgttcggtacagacaatcatccatttgtttaaaaaatatttttgatctgcaactggctgaatccatggatgaggaacccacagccgcagagggctgactgtatttttactgacaaaagtttaaacataaaagcaataaccaaaaaaggtagtttagtcacaaaaagtttaaagtgaaaattaaattaactacaacatactgtaattcatgccaaacagttgttcctcctaatcaatatttgaattttgaaagagaagtaattgtatatatattgtaagaattccactgtagatgagtcacagagcagattgatgatcgtatttttttgctatggtagttaaaactttttattcagatttttatttagtgctaaatgagttcaaaatgtatattacctctctggaaaagctcttatgttagactgtcagctatctagtccattttatattttcaacttgaaaaatgtttaaaatgttaatttatttcaattaaaatttaacaggttgaaataaaatgaacatcagatttctcttttgattcactccaattcagaaaaacaacttttgaaatcttacaatgtggtaggcactgaacgtttcaaagactgttaggaaatggttcctgtgttttcaagctttttccagtggccagttggtcacatttatcaaatgtactaaaactatgtttttagacatactctttaatatattcatgtgaagtttacagaattatgtttgaacacaatcctttttgtaggtgttcacagtttctatgaggttttacttcactggttttcatgttatcttcataatagcattttaatgaatatttatttctacccaactccttactattacagctggagggagctgtgctacaaagagagcactctctgttgagagaaacttggaaagttgagttaacatattggcctgggttgctaatcccaaagaacaggaagtcttagggctagagtgagggaggagattgggtggaaggggtatagtctgaagtctccaaagcttagagctctgacagcctacagttttattttgcccttccaatccatccaatgtgactcttttgacattcttaaaataattgagaaaaaatttctgatatagcttgtaaattctgctaattgatcctttagtaaattgaccatttggcaaatagtcttttctgcgactacatcaagagtccctgttgtcaaagaaatgccttagcaaatggaagatataaataatacctttaccaagttacaggtaaaaaggtgccctattaattaagtctgattttcaaaataacccactgaagagtacagggattattatccctaattaatatctgtatttaatactggaagattcagagaggctaagtgagttgccctcagttaaaagataatgaaaatggaggaatcaagatttgactcaggcattctggccagtaagtgtatttccattataccattctgaagataatcactttgtttaaataatttcatttttcacattttgagggctagagagatggggacgggagatgaaggagtactgaagtttgctcacttgatgacatgtttatgtatacttttcctgtacttaggaaatcaatttcacaagacattgttttaagaaattttaagcctgttattatagacatgaattaactacacactgttaatttagaaattattgttagagcagttattatttttgtacatgacagcattagaaaataatgaagttctaatattttgatttttatagctcacatccctattctgggtctcctttccaagttttcaaacttagcaggaccacagaatttcttgttttagactgctaattatcttaagacaaaaagggatcatcctaggttctgctggttctcacattaaagagaaatttccattttccattaatgtattcaaatacattcactttaaagatacctatactgtactgctaaagagattaccctctatgtcttattctctattttaggacttcagctttcagaaacagctgtaaaactttcttaagcattatgaatataatatttctcaactcatcttaaaacacttactatttactatttctcttattagatatggcttctgaaatggtttaattgcacttcaaaactatagcattttattgattttattttttgaaagctgctttatgttctgtagtgtttaatggaggataagttactagtcacatatgatactgtgcatacgctagatttaaatgtttagtgcttacttttgacaactacgtaaagaagatctatatactagttctggatttatttttgaaatggaaaattgtgcttttaaaattattatgggtagcttcagtttgtatcacagtataccagcaccaatacattactggtgtcatcttacgtgatgtatgaaaatttgaggtactagagtattggtaaaatgctatttacccctatattcttactcatttaaatccaaagctaagtctttctactggtactaaatattttacatcgcaatggaaaattttaataacgttgtacaaaaatatatagagaaactaacaaaaatccaaatgacctcattcatcttttaagcagttaaaggcagtggaataaagtgtgcaaaataatgacatgcaagatgaaaaccacctaaaccttattttcctttcctagcctagcttgttctattatgggttttatatgaacatactttgaaatgaaatccattagttgaaaaacaaaaataaaattcttaaccaagtggcaggcatatacaatagtccccccttatccacagggaatatgtttgaagaccctccagtggatgtctgaaaccatggatagtacctaaccctttatatactctctctctctttctctctctctgtagtgtatatatataaaaaaccaagactctctctctctctcatatatatatatatatatatatatatatatatatatatatatatccatctgatagccaaggcagctaccaaatgactaatgagcaagtagcctatacagtgtggatacactggacaaagagaggatttgtatgccaggtaaaagagtgtgggacagtgcaagatttcatcatgctactctgaatggtccacaatttaaaacacatgagttttttatttctgcaattttccatttaatatttttggaccatggttgattgcaggtaactaaagctgtggaagggtaaacaaaactatggataagtggggggctactgtaacataatctttggtttttaggtatatctcagatgtatctgaaataaacattgagatactgaatgaatattttatagcaaccatcttttctttaaatctaagcatccttcttaactctaaaattatgaatctaatttgtgttacattttatattgctaatttcttatttttttattttatattttatgttcagtccatctttccgttgcttggaatatttttctgaggtaattagaaatttatatcttctccttagatttttttctgaagtcttgttacagtgtgatggtttttcttcatttaattaattagagaaactatagtataactaaattcatgattgaacacattttatacaaattacaattgagagccgagggactatcttcagcattaaaaactcaaacattcctaactttactgtaatgcccttcaaattaggattgggtttatttagcatataagagcaagggctatgcagtacgtaaatacaatacgtactaaaaaaatgttttgttgcatattcatttatttattcatatatattattacaattttattgaattttgtacaaaccaatgcagcaataaaaaactatggcttagtctatatcctcatgaagatgaggatagactaagatataaatatagatatagatataaatataaatatagatataaatatagatataaaaccaatattcattttaatcatcctaagtgcttaaagaaaacatccaggagattagagggacctagtttgggaggacagggaaggcttccctgaggaagtgatatttaagctgaatctttaaacatgaataaggattagataagcaaagagaataggaaattttttttaatatggacaaattagagcttaatattttaaaaatatataaatctgagattggatattccgaactaacaattcaagttatttaaacattgtgagctttataacaacatggaaataacaatatatggcagttttagaaccttgctgaaaaataaccttggtaaatctaaattttatttaaaatgaagctgtgtggcacacattgattcaaactgtctgtaaatggagtattgagaaggaatatgacagccagcaaatgtcaatggcgactttgattaagaacagaatgttgaaaaacaaatacctaacaaaaactaatcaattaaagtgtgtgtggagtggagggaggaatagctcaaaacacgaaagatgtttataaggagccactatgatatctaattctccatgccatttaataagcagactagccatgactgtgtacctgacctgttgaccccaataactcattattcaagtgtttactagataattttcatccaacagcaaatttcactgtgcctattctaggtaactgtatgctggggccctctgggtgataaaaggtgttttattagctgcttccagacaccccagttctcacaaggttaaataaattgtatgcctgctaaatgagttagcaggagatttaaaaatagaattcaaggttttttttttttttttcctttgtgctttcttactgtggttacactatctttaaagtttgtgttggtttttcagcagcacaggtctagattagttgcatttgtatacttccaaagagttgcatatttatttgtcctaatatatatatttaaaaaaaaagttgttcagagataaagggtaaacacaataagcttactgatcattcaaaactgcctgtacctactcatttgctctttcagcaagtgtttattgagtatctgtggtgtgtggtgttgaagggttatccttaggaaacccaagaaaaaaaaatgtggtcttggccgggcgcaatggctcatccctgtaatcccagcacttggggaggccgaggtgggcggatcacttgaggtcaggagtttgaaaccagcctggccaacatggtgaaaccctgtctctactaaaaatacaaaaaaattagctggacgtgttggctggcacctgtaatcccagctactcgggaggctgaggcaagagaatcgcttgaacccgagagtcagaggttgcagtgagccgagatcgatccactacacttcaggctgggagacagagtgagactgcatcttaaaaaaaaagaaaagtggtgtttgcacttgaggagtttttgatattactaatgttatgaaaggtctgcatattctcacaagacatgaagctgaaaacgtaaaatatccttctgaattctggggttttttgttttaaattagggagatttggaaaatacctgctatagtatttcatttctgctgtgttctatgtgaatataatgtgaatgctcactgaatgtatatgctataccactggttgaaacttctgcaagtttattttcacttttgaaggtgtatattatttccatttttacaggaaagagggagtaaatacactcaggactaatagttgcttatttacaaaaatgttcagaaattacaagtcattactttaataaaaagtttatcatagtactgagtgtttcaaaatattatttctagagatattgtttattttcagagaaacaatctgttgaaatgtagatttctaaagtattttctgcatttgatatcaagtgtccatagaaaaacgcagtatcctttaggggtaccaagctaactaataagtgtgtttcacatacatttcgaaagttatgttgcttttattataagttggaattttcttcccattggaataacgagcgttttctttaaaaaggctgttaaagagaaaaaaacactgacccaggagtagcccaaacacctggattgtgatgctttcagcgatatagctgcatgaatttcaacagcacagtcacctagcatgaatcttgttttctttgttgttatctgccctgcatgtcacacatggttgttacgaggatcaaatgacataatatatgtgcaaatgcttgtaagttacaacttgttgtataatgtaaggtacacctattttctgaaagctaagctataagtattttttatccagtagagggagtcaaccatttgcatgttataaaaaccagatctaaatttcttctcctcttaaaataatttattcttaaatcaaagtaaatatttggagtaaagtatatgtgtgtgagaattcatttttattgatagaacagtgataaaatatttgatgaatacatgggtatttaataatatattacatatattgacaaaactcatttgattcccttgaagtacacttttttaattttgtattccagggtactaggtaaaatcattcatggtggtcattggttgtttatgctagatattggactatttcagccttgatgtctactgtgaacactgatgtagtggccagtggtgacaataaagtaaattgacaaccatgagtcagaattttagaacttggttgaaccttccatgtggcatggctgtagatgaaatgaaggctcaaacagatgtggtgaaatggcattttatctggcctattgacaatatccaaggagtctgctctggtcatgagaatgcagctgcatgttctttcaggcagacctttggcagaattgtggttccaggagatcagtctggtttggagcaaaaattcttgccaagctttgggattcaccatgcaggatgctatattcaattcctagagggaaaggttagcataatgccaagttagctagtgttcaagtcaggttcctggcccagcaagggacgtttaccctaagtacctgggactcaagacttaggacaggaaagataaatctagatgtgacttacaggcaatactgtggatcctaactattttgagttcccttgtcataattgagcctgcagacagtaggtgtcattgcctggaagcagccatttgtgaggctggaggaacatactaagaaacacacagctgaaatgtgacagatatgtccgcttctctctgcttcttttaactgatgtgggaatttgattgatacaaccaagaaaaacttgttatttttgatacctctgaagacaatccctgtattagaaatttaaaagcctggagtcacatgtatttgtgtctcatgttccaattgaaggtttgaattttgaaagagtttaggaggaagataagtcaatggttgactatgtacctaaatttattaaaattttaaattaaatatttagtaaagtgatgtgttatcaataccatttccttataacaatagtagccagtttgagaacatgatgaaaaaggtcacattcataatagtaaacaagtataagctgattttaataagcttaataggagggtatataacctacataaatctacagcactttgagagctatagaaagcgactagaataaatacgaagacagtgcaattctagatggataaaggccataaatatataaaatttctcttgtaaatttatacatctaacataattataaataaaaacaggaattttagttgactttattgaatttagcaagattattatacagatggaagaggaaactggcaagaatgtaaaatgccattttgagaaccatgggcaatattttggtgatgggggactaatcctataaaaagatgaaggattcacatttttaaaaaagggagatattataatagcacacacattcatgtaaataagtgggaatagaaagaaagttcaataatagattcttatttatttatttatttatttatttatttatttatttatttattttttgagagggagtctcactgtgttgcccaggctggagtgcagtggtgcagtcttggctcactgcaagctccgcctcccaggttcatgccattctcttgcctcagcctcctgcatagctgggaccacaggcgcccaccaccacgcccggctaattttttgtagttctagtagagacggggtttcaccgtgttaggcaggatggtctcgatctcctgaccttgtgatccgcccgcctcggcctcccaaagtgttgggattacaggcgtgagccaccatgcccgccctagattatgtttttgcatatgtatattataaatatgaactatgttttctgtaaggatagaaaataatggggaggaaatatacattccaataccattcattaagtaatctgcctgtaaatctggctccataactcatattgtgtaccaaaatcatagacagattaaaagtaaacattgaagtgaaaatattgtaagctttgaattaattgaagttacaaaaggacagatttacaactttgaataaataaaagctaaactgtatagaatgctgtaaaatataaaacactcagaaaaatacctgcaagtttattacacacgggattaatattgttagtatccatgcactgcatagaatgtgatggaagcatctaggtttggatagataaatgtgcaaaaaaatagacaatacgtatgagtggaaataaaattagtaaaatgggaaaaactttaacataccaattgagaaatgcaaaatttgaaaatgaggtatcattttccatcttttcaattggaaatcttaaaatggcattgcctaataccatgaaatttgtgcattactgtattatgctggtagcattaaatctgtttgaaaagaatttgacggaatataccaatccttgtatctattgacccctgtgatttagtattttggacaatttaccctaaggaaattatccaaaagaagaaaaaagtatttatttgcaggattgtttatactaatggaaaattggggtgggcagaaaccttaattccaagagggcaatgcttaattatgagccatacactcaggagtattatcaggtagacactagaatgacttagatatgctgtgtagaaaatgaaaacattcctctgatacagtggttaaaagaaattacacgtgtcatatgatgtatgctttcagttatgtacaatgtaattatataatcgtatgttagatgacaatgtgaaaactaagcttctagtctggtgggatttttaatgacttataaaaaattctccccggactttatggggtaaaaggaaaatgagaatggcagagatttttaaggttttaatgttatgaatgctaaagtattctgctaagtaaaaatgataataacttttattgatcatgttctatggaccaggaaccatagagtgttctgcatttattctttcgttctgaaatgcttgaaaactgaaaaggaggtttaggcaggatatacttgtctccataagatagaagggctgtgataggatggaacaatttgaatagtcctttttcattccattggaggttaaaaaaatctattatcagtaaagtaaaaattataaggaaacagatcttaatgctaacaaaacaaaacaaaacagcaacatacgtgtccctttctttgctttctccacctcaggaaattgacattgccgtacttccagatgtctaaactagaaacttgtgtttcatacttgattccttgcacttcctcattctctacttccaatctgtgaccacattctatctattctaactgctaaaatatttctgaaactcatctgctccttcccattacccctgtcacctttttagtttaggccaccatcctcatcaccttgattacaatagcagtctcctaactggtctctttccttccatccttaccccctttcttctattcgctacacaaatctaaacatgtcactcaccagcttacaaaaatcctcagtgatttcacttcgctggattaagtccaaaccccttaatggggctttcaaggtcttcatgacttatatttacttcaccagcatctgctccccagcaaataaattcattctccctttcctgctccttgtccctttccccaccccatctctctcagtcacacacatgcaaatgtacacacaaatacatgtacacccctacagccataccgaacttcttccatttccatgactctgtttcattctctctcatcactgaatcttccacggtgctgtgccctccacctggaacactctccgttacttgtccaacctcgcctgagctttctcttatgatctcttgttcttgcttatccttcagttttcatattagacattccttctcctacaaaggctttttggacatctgggttgcatcctcctatgtgctaccctaataccccattccataccctttatacttacattactgaaaaataaggaccacctgagtagcattgtacctttggtttactaccatatccgtagagttagcagagtgtctggcacatagtagatgcgtgctaagtattcattgaatgaatttgtatggtttgggcctgtgttgtcaactacttaagatttatatttttaacttcaaatttgagcactgtcttcttggtcatcatattattaacaacaagcacaatgccaaacacggtacattttcagtaatgattggaaatgaatgagtaactcagtaagtatttgaatgaatgatcattgtaatggtgacacctcactgagattaatgagcattcatcctttctttaagttccctgaagggaacttcatttgtctctgttttacctaacatagtgtcttacatgtagtagacactcattggataattaccttcaattcccaagactgaccactatgtacagagttccagctagtgctggcgttaattaggtgatcttgaccatatctggaatttgaacttgagctggatttctctgtatatttgtgtatgtgtgcctgtatgcatggtcatgtcaacatatattttttaaagacatagactggttttgtattatgtatacagtgaccattaaaacaatgccatcacactacaaccagtcagagttctcttcttgttgttggttgttcatttgttttactgtggttgtttttgccttggactttgagagaatcctggactgtaaacttttaaggcaaggtttaagtcttgtcctaatcattcactgtgtagtcaacaagaaggtgttaggacttgagaaaaaaaattacctgaaggaaatatatatgagaaacgctttatggggaaatttttttgtcttttctgcttgactgtagaacttcaggtgttgtgtaatacgtattctttcacctccacttccctctgtaaatgtgctttactcataaatgtctgtctataaagatgtgtcctgggtctttaacaagtaggaggtggtacatacttgaataaacatcctctaagtggttgaggttgaaaaggtgcaaatctttcctagttgaagtaggagaggctgtacctgctttgttatgagtcctttctttgtgttctcattattcctttttttttttttttttggttctacatttttttcctgtactattttgtacagctcctttcttatttttttctttcacctctcaactctttcattatcactcttttttcatttattgaaaccatatatccatgttttttgagtgactttgaccagaacagttggttcagctttctttttaaaataatatttaatgtatttcaattataaaagtaacaatctttaatttagaaaatctgaaaacaaaggaaattttaaagaagagagtatgtatctaaaatcctcttacttaggtataattatcattaacattgctataaattactatttagattttttacctaattgaaatcattctgtacctagagttttttttacctaattgaattttttacctagttgaaatcattttttacctaattgaaacattaggtaaacatttttacctaattcaaataattctgtacctagagttttgtatctcattttaaataatattgagtcaaagatgtatttccacatcattaaaatactttaataggccagacacagtggctcatgcctgtaatcccagcactttgggaggccaaggcgggcagactacttgagcccagaagttcgagatcagcctgggcaacatggggaaagcctgtctctcttaaaaatacaaaaaattagccgagcatggtggtgcgcacctattgttttagctactccggatggggaggtgggaggatcgcttgagcccaggaggtcaatgctgcagtgatatgtgatcacgccattgcactccagcctgggagacagagtgagaccctgtctcaaaacaatttttaatggctgcataatattccattttaaatagataaagcttacctctttatttcccgatatttgcactgttcaatgtatttacaagtttctctgatataaaaatgatgtcatgaataacttagaacgtgaagtcctagctacagttcagattgtttcctgtgaaagattcctagaagtagcattatcaggtcaaaaataagtcatactttttgaggcactttttttttttttttttttaaccacatggctttccagaaatgttatgccaaatctgctcattgctatcagcattgtaaaagaatatccatcttaccccatgggtagggctttttagtttctttaacggtattgtagtttctttaacagaatattaacagaatactgttaaaaatggataaaaatggataactgtgtgaactgttatcaaattaattaaacaaagaatattatttggcatacatatttgaatcttgttctgaaggcagtgggtacatggtgtgttttcttacaattggaatgtcttgtgtgtgtgtgctgggttgttattctctgaaattgcattactgtgttaaatccccaaactaaagcagtgaatttttttgtaagttctgtatctttgtggccttgacaactgagccagtcctttggagaataagcaatcctggactgcattttaggacaatgagaactgccaaagtcatgagagagaaagacgaatggataggacactgaagtagaaatcagatgccctaggctttattcccacatccatttgtcattgtgtatcatggccaaatttgattaaagaactttcccaatctgtaaaacggggataatatgtctcaccttacagggatggtaaagggattactgaaatatttttttctaattcattttgtgttcttccaaaagagctctaatattcagaaccaaatactgaaatctatccaaaatctgaatggtagaaattaactattatactttcaagcattttaaaccccagtttattaagaacctaaccccttagtgaagagggacagatagtcaacagaagaataaacaaagaaaataccaaatagtaatgagcctccaaaagactaaaacattgagtgttcttttttgttaagatgccattttaacccatttatgccagaggctgcagattttttatgtgaacaatcagaccttggcgatgaccttgagcagtaggatataataactcccacaagcttagtgttccgatactggaacagtaggcataagtgggttagttgtgtgctgcatcatattggttggccagagaaggcctgtgcaaagaggggatatttgaatgatgggaaggagacaaccatgttcaaattcaggaaaggggccctctaggcaaaaagaagaacacatgcaaaggtcctaatgtgagaatgggttttgagtgtttgagtgccagataagagaccagtttggaagttagtaatttggggcaggggagggcatcagatgaagttgtagaaagaggtaggggaaaaattacccagggcctggcaggcccctggaaggagtccaaatagtccatagtttggatctctcatacttactagctgtgtgacctcagataaagttttttaacttgtgtgaatttttgttcccatttataaaatgtgtgtgattactgcttttcaagattgtttctaaggattaggataataaatttagtgagtagtacagtgaatggcacatagtacactcaagaattggatattgttgatgatgatgtttggacaggaaataaatgtccattgtgtacctaactatgtgtcaggcatagggccagacactttacatttatttatatttaaatcctcaaaacaattctataagatataatgaaactgggaaaaattgttacttgtacagttaaacagtggtcttaagtagcagactactggattcaaatcaaattttcatgactccaaaattagttatccctcactcctgtatcatatcgagggagtcaatcagttgtaatgtgttggttgcttttgtatgtaaatataatttgtgactagacgtgcttttagagatgaggccagtctttgaccttacatgaacagctcttgccaggtgggaagtttgtgaatgttcatattcctctcaatgcttaggatcatgcctcgttcctcctagaatttcttattatattccttgactaagtggatctgcataacaatattaatacttgcctgcaacatgccccaatttttaaaataacctaaggaatattcaggttttttgtttttgcaagatttcttatttttcccaaagacatatttcatatagcagtcttttcctttgagagtgttttgcccttaattgtactagttggaagtgtcagaatagtgcattaacctactgagctccagatggctgacttttttttgttattttatcttgtcttgtttaaaggaatatagaattggcagcagagcccactaactgatgtcagatttggttagcataaattgtatgtttaatatcaagtaaacatgcacttaaaaatcatatgagttgtactttttattctttgctgtacaaaatcttcactgaatatatttgataagttgaaaggctcattcattttgtgagaaagtttatgagattactgattatattacttattgaaaatatttagtatctatatcctactttgggtgtagaaaaaagaaatgaagccttttggaggtatgtgtgtgcatgtctgttgaattgttagattatactaattttttctctgagaagtaaatgacatgctagaatagtaaattgtataatgtggaccatgaaaaagtattatttctaaaataattgttttgaggaaacagaaatgtgtgtttccttatattcaaattcacaacttaggtccttagaggtaagaatgctaccagcagaaacagatggttggtaatctgtaaaagtaatgccatcatattgggtaatgccatactgctgtttctattggcataacctctaactatgacatgatatatagcacttatgggccagaacattgtttgtacttttataaaaaccctacaaagtctatacgctcaagtactagctcagtattcttatcaggttgggtttttgttttgttttgttttgttttttttagacggagtcttgctctgttgcccaggctggagtgtagtggcatgatctcggctcactgcaacctccgccacccaggttcaagcgattctcctgcctcagcctcccaagtagctgggtttacaggcgcgtgccaccatgcccaacttattttttgtatttttagtagagacagggttttaccacgttggccaggctggtctcgagctcctgacctcaagtgatctgcccgcctcggcctcccaaagtgttgagattacaagcgtgagccaccgcacctggccagattgttctttcaagttaggataggactttggggtaagcagtatttcgtgatattcactgtataccattttagaactgaaattggttcatgcagcaaagatgaattatttatcacaaaaggcttgaataacctatacatgcatcactgctatagaaaataaacacatatgtttgagtttgttaggtaaaattagtttattgaaatgaaatcccccaaaatcaactttcatatattttttgaatttatatatactaatataaacaagtcattcctcttttaaatattaaccagaggagtatcccactaagatactatttgatttcaaatatgtcagtgttaactttaaatattttaattatactgtttaactacgtggcaacatagggtacacactatagcagcatctcttatacaacttatcaaatatacatgttaaatacaaaacccataaaatttaaattaacattattttaagtaataaatcatttgctgactctaaattgccaattacaatgtgaatatactacagtgcgggcacttttgggttctctgtgcctaccgtgccgtaggataacccaactgtgccactagtgttctctgatctatggttaaattttgattggtatagcatgctgcgatgtcatttggtctttattttggtacatatgtgttttcacactaaggccatctcattagccagaggtaatgaaagttgtacttcctggtaacagtgtgaatatatggatgctgagactaattggcaggacttggttataaggtagttatctagatgatccagcttatgcctagctttatcatattaagaaatgaaacttcagaattttaacattaccttaccagactcagggatgattaaaactatgttcaaggatcccagtttgagtaccattgctgtgagctccaggtatattgatctaacaaatccccgaacatagcatgttgtattatgacccaatatttattgtaatttctaactgaaatagccttatctacctttggtgaacagtttttacagctgggcagaccttcttcccccgcatagagtcaagtcctttaaccttcaaactcccttatcaccccctatctattttgaaggcacatatcacattgacagtggtctgcatgttgttgcttaccatacctgaataagctctgctgggatggtgaggatatatcatcgcttatctctgtactctcagtgcctggaacctcatgggaactcaattcatgctgactggtaatattctaatacaaaaatgataccatatgcacagtaagagatagatgccttgtgtctctgtagtctattttgtgaagaaaccgagaatctgtataatcaatgtgtgtgcagagaatatagtgaatgtgtgtgcagagaatatagtgtccaattaaaattttatgctttaaagaagaaaagcttttgctttagtatgcatatagtggcatattccaaatcatagattcaacagggcaggacctttgggatcatctagctcagtgggtttaaaaccttattttatttaacataagagcagcttattcataaaaaatcatatgtgggatatgaataaattagaagataaatgtgtaaatgccctcatttttgggggagcagagacttgggaagtctccccaggagccttccttttttgcacattccctactcaccctccaaggcaacctggaaaacacctcaaggaattccatggacccctgtgaaaataatagtcttctcaggccggacgtggtagctcatgcctgtaatcccagcactttgggaggccgaggtgggtggatcacaaggtcaggagttcgagaccagcctggccaatatggtgaaaccccgactctactaaaaatacaaaaattagctgggcgtggtggcgcacgcctggagtcccagctgctcaggaggctgaggcaggagaatcacttgaacccaggaggcgcaggttgcagtgagccgagattccgccactgcactccatctcaaaaatactgctactactaccactactactactactactactactactactactactaatactagtctcctacctaaggtaagaatccttttccagcatctcagacctagtggcaggtctttgcttgaataatttaggtgaacagaaactaataacttcataacatgagcagtcaactaggcaattgttaacgaaagtactcactaaattaatgataaaataatgtataatggcaccaaacattagttaagtgcttattatataccagaccttatgtttgaccaggatccttatttcacccttatgacaagcctgaggagggtagatgctttattgttcccattttgccaataaggaacctcaggcccaggaagtcaagtaatcacttgactaaattcatacagctattaaggtaaggaatatttcagaaacttttgcctgcttttccctttttgttataatcctcctttggaagcaaattatgcccctttttaagatggttttgtactgtcctcagagggcgactctatagcctgggttctagccttgcttctgacagttagatatagtctcagacaagacatgacttctccgtgactcagttttcacagcagaagaaaaaatggttttagtaatattttccctgttgttagattcagatgaaatagtatgcaggaaaagttgtgaaagctgtttttgctatagaagtttaaggtatcctttatttatttattttttttcttgagacagagtctcgctctgtcacccaggctagagtgcagtggcgtgatcttggctcactgcaagctccacctccggggttcacgccattctcctgcctcagcctcccgagtagctgggactacagacgcccatcaccatgcccagctaattttttgtatttttttttttttttttttaagtagagatggggtttcaccatattggtcaggatggtctcgatctcccgacctcgtgatccgcccgcctcggcctcccaaagtgctgggattacaggcaatcccattcagtgctggaggcacacatccatttattcatgtgacaattagttacatttctttttatttttccttgttttcctatcctttggccattttactattgatgcactacctcccatcagcaggtagacaaggaactgataaaattcagtgtgttcattttgtctgatagcacttactaaaatgtttagaaggctagcgttttgaaaataatagggtaattttttgttttgtggaaggaatatttctttatttcatttacaatgtatagcttcattacctacttaaaatgcagtttatatctaggctgtaggatacatttataatctgcaaaagtattattaaacttgctttgttacactgtctaaagttactcttggaatcggatttacaaaatggtaaagcagagagggaaaccattttatttaaataccttcataatctttgccccaacacaacaaatgttggtaagtcttactgttgttcctatctttaaacagtacaatgaagagattgcctatgcgaaatacattggttatcctattgcacattatcattgatcaaatcctgcccattttttaaagtcactatttacatacatgaactttctttatttaaaatggtagtgggccgggcgcagtggctcatgcctgtaatcccagcactttgggaggccgaggcgggaggatcatgaggtcaggagatcaagaccatcctggctaacacggtgaaaccccgtctctaccaaaaatacaaaaaaaattagccaggcgtggtggcgggtgcctgtagtcccagttactcgggaggctgaggcaggagaatggtgtgaacctggtaggcggagattgcagtgagccgagatcgcgccaccgtactccagcctgggcgacagagcgagactccgtctcaaaaaaaaaaaaaaaaaaaaaaaaaggtagtgtactttttcttctgtcctaggacagtgggtggagtaaatgcagtgtaattccaaaatagaggtaacaggctactagaagggttcttactcattttgtgccatgggcccctctgaaagttggtgaatttatggggacctttttagaatcatatttttagatgtaaaacacaaaagacataggattataaaggaaaccaatcatattaaaatgtacttataaaattgtttttaaaaattatgacacattccagagacataaacacatatgttcacacaaaaacctgtgcatggatgttcatagttttattcatagtagacaaaaactggaaacagcctaaatgttctttaacgggtgagtggttaaataagctgtattatccatactatgggatactgtatggcaataaacaggtataaactattgatatacacaataacttgtgtgccttcccagggcattatggtgaatggaagaagtccatgtgccaaaaagttacatatagtatgatttcatgtaaatgacattcctttttttatgggtacatagtaggtgtatatacttaaggggtacgtgagatgttttgatacaggcatacaatgcataataatcacatcagggtaaatggtacaatctttaattgtacaataaattattgttgactatagtcaccctgttgtgctatcaaatgccagatcttacccattctgttaaactatacttttgtacccattaactatccccatttcccctccccacccacttcccagcctctggcaagtatcattctactctcttatctccatgagttcaattgttttaaatttttgctcccacaaatgagaacatgagatgtttgtctttctttgcctggcttatttcacttaacctaatgtccttcagttctatccacgttgttgcaaatgacaggatctcattcttttttatggcggaatagtacaccattgtgtatatgtgccacattttctttttcttttttttttttttttgagatggagtcttgctctgtcactcaggctggagtgcagtggtgtgatctcggctcactgcaacctccacctccctgattaaagcaattcccctgcctcagcctcccgagtatctgggattacaggtgcacgccaccacgcccggctaatttttttgtatttttagtagaggcggggtttaaccacgttggccagactggtcttgagctcctgacctcaggcaatccacctgcctcggcctcccaaagtgctgggattacaagcatgagccaccacgcctggcccctgtgccacattttctttatccatttgtctgtagatggatacttaggttgcttccaaatcttggctattgtgaatactgctgcaataaatatgggagtgcagatatctctttgatatactgattctttctttttggcatatacccagcagtgggaatgctggaccaaatggtagctcaattgttagttttttgaggaagctccatactgttttccatagtggctatactagtttacattcccaccaacagtttatgagggttcccttttctccacatcctcgccagcatttgtcattgcctttcttttggatggatacaagccattttaactggggtgagatgatacctcattgtagttttgatttgcttttctccaacaatgcatgatgttgagcaccttttcatatacctgtttgtcctttgtatgtcttcttttgagacacgtctactgagatcttttgtccatttaaaaaaatcagattattagtttttttcctgttgagttgcttgagctccttaaatattttggttattaatctcttgtcagatgtatgtatagtttgcagatatgttttcctattctgttgtctctttgttgattgtttgctttgcagaagcttttgaacttgatgtgattccatttgtaaatgatacttttgaaaaaaaatgatagaagtggagaataggttagtggttgctggggtggagggttgtgggaaggagatgggtgtggttattgaaaggccaacttgggggatccttgtggtgatggaactgttccatatcttgattgtggtgttggtatacctgaatttacacatgataaaactgcatagaaatgcgtatatatatacacacacacacacacacacacacacacacacatataaaaatatatatacacatgtatatatacacacacacatatataacacacaaataagtacaaataaaactagggaaatttgaataagatagatgggttttatcaatgtcaatatcccagttgtgatatcataatatagattaccaggatgttaccattgggggaaaagggatctctgggcattatttcttagaactgcatgcatatttccaatatctaaaaatagtttgattaaaaaattgagacacagtaattgtagttctttacaatatttgttaaataacaagataaagtggcaggttgtataactcaagtaattttgaagaagtgataagcataaatgatagttaaggtattttcacaagtgcactatgtgtggtataacaggaaaataaatgtgacttggtgaccaagttgcaggggctgctaataccactgtaatctgtttcctatattcatagttgaaagaagtactagatttaagtaagaggttactgaaaatatgttttcctttccaaattcacataccccctaaatttagaccccaggataagaacccctgactttatatctttttacatttcattatctgttatatctcaaaggcctctgtcaaataaaagagaaacataatgtgtatttgttttgcctcaaataccatggataatgatgggggctcatagaaaatactagtggacacacttcacagttttaatgatttacttgctattactcacccatatgcccattgttcaccaaaattgcttaacactagttttaaaagagaagtatatgtggattttaagtatagaataaactacacattattgatatgaaaaagaaatatgtcaaattgattgcttattatccagattgactaatattgactatcattaaatattttaatttgctttcgctaggaaatcagttaatgatggtttagccttcaattgtccgtatctctgagagtatctagatcaaatgaggctattgttttataagaaaggaaggttagtgttttgggattaatgttctactttaaaatatcacctttttgtttcctctaatgttaaaatctaaaattttttgaatatttgagtaattatttgaaattattatgaagtatttcctctatactctattggttaaatatgtctttcataacataagaagtaacaatatggacacagaattaaaaactatgtttagagtttgtgtacttgacatttctaatacaggctgagcatctctaatccaaaatcgaaaatgctccaaaatccaaaacttcttgagaaccaacatgatgccacaaatggaatattccacacctgacctcatgtgttgagtcacagataaaatgtggccaaaactttgtttcatgcacaaaattattaaaatcattgtataaaattatcttcaggctatttgtatgagttgcatatgcaacataaataaataacatgtttcaacttgagtcttgtccccaaaatatctcattatgtatttgtaaagattacaaaattggagaaaatcagaactctgaaacacttctggtcccaagcattttgaataagggatactcaatctgtaatacaagtgctcaaaaaatcatctaaatatttgttctgtgatggtctaagagtctgtaatttgggagtgaaatgcttaattgatatttagtagacagaagcttcaataagggaacaataaatgatttcatcatatacaaccttatacttttctttcattaaacattttagctaatcatattttagtaaacttatttaaatttttttgggaaaaatggcacatataatctgaagaattatgatgcttatacattgctgtagaaaagcttttatcacccctgccctataatttgcggtatattctcttgttttgcctattattttcatcctctgaaaatgccttagttagaaacagtgtttcctgcaatgggaaatgacacaatatgaagttaacctgatgacagtaattttctgtgtaggtttttttcttatagacttcaattgataatatgtagtatcttttaccctacatttttttgtgtggttaaaaaaaataaattaaaaaaagacttaaaggttagacctaaaaccataaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcaccgcaaaagaaactaccatcagagtgaacaggcaacctacagaatgggagaaaatttttgcaatctgctcatctgacaaagggctaatatccagaatctacaaagaactcaaacaaatttacaagaaaaaaacaactccatcaacaagtgggcaaaggatatgaacagacacttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactggttcaaccactgtggaagacagtgtggtgattcctcagggatctagaactagaaataccatttgacccagccatcccattactgggtatatacccaaaggattataaatcatgctactataaagacacatgcacatgtatgtttattgtggcactattcacaatagcaaagacctggaaccaacccacatgtccaacaatcatagactggattaaggaaatgtggcacatatacacaatggaatactatgcagccataaaaaatgatgagttcatgtcctttgtagggacatggatgaagctggaagccatcattctcagcaaactatggcaagaacaaaaaaccaaacatcgcatgttctcactcataggtgggaattgaacaatgagaacacatggacacaggaagggcaacatcacacaccggggcctgttgtggggtttggggaggggggagggatagcattaggagatatatctaatataaatgatgggttaatgggtgcagcacaccaacatggcacatgtatacatatgtaacaaacctgcacgttatgtacatttaccctagaacttaaagtataataataaaaaaatttttcaatgcaaattgcatattaaattattttaagttttattataaattgattttaatatattttttatattttttgatacataaattacataactgtattactctcccagtaagagatggctttcttacataaatggagagaagccatctaaaggttctgcactatatagcattctctgttcaaaccaaatataccgctatcagaataaataaatagattcacttggatagggcacttattttgtgtttccctttcctccttgaactcaaggaactgatggtgatgaaaatggcattttgatttcttatgtttgaaagttataggagcctctccaagaacaacagtatgaacctttgtagatataatcccaaatatgttaatctatagcattatattttcagagaacatgatgatagattagaaacttatttgattaaaatagccaaagaaatggacttcattagggtttgtaaatcatggtcaataacactaacaaaattactgttttcatgaaaatattgcccatcctatttgaagatgacatccctgatactaattgctatctatgtgcatgctgtatagctgaaaagacctgtgtacaatcaatagttctgtctagtgtctgcagcaagatacctttacagctaagaaccataaagccttttcccaagttgtaagtaagtctgtttttacattaaaaaatgacagaccatgctcagactaagtccatctaaactcagaagtgattatctccactgcaaactagaagtgttctttcttagaatattgcttctctgctgttgattttaacatttcatatcagagcaaggggaatctgtgactattaaactggcccaaactaccttttgattatttgtgtactgtcttaaaataatacaagcccagtcacattgactagtatctccatcctaatgattttcaaattaaggaatggcttcaaattaggaaagctctttgttcacctaggtttggaatagcatgatgtatgctaattgctaactttgtctgcattattttttaaagatcaaatgggcacagtggtaattttcattaatctcatacagagcagctaattaaaatttccattattacccatccattatctagttgtttcctttgttcagtatcagaacaggatgttaataagccattcttgtcttacagccctattaagtattatgagaattaatgtattgcactattttgtttttaggtgattttaaaaatattttcttgcaccatattgattatactgaaggtactttgacaccttgacattttgtaatagagatttcagaattaaatacttgttgctttaacgttttattcaatattgagcaaaagtagtatatagtagagacaggagctatccaaggaccagaatatttgttttagtctcatactcttactgattatgtgaacttaggcaattacttggattcctcatttttgtaatgaggatattagaagaactgatctttaagggccagtccagccttagcttgctatcatattttcataattttcaaatatgaacttatgttaaaatctcaaagtccttctaagcttggtaaaaagcatctgttctataaagttatatattctctgtcatgctctagtagattgtttgcttccattccttataaccagagaggatcctaaattttataatttaagcttgtttctaagacttgggtggggagtgagccacaaagtgatgggctggctcacttgtccacaaggagtacctcggccataaccatatgtcccaattagactaatcctgtagggaatcaattagaaaaagggaaccaacattttctcagtagattattctgtgtccatgagatgcccaatataaaatacctctgagctgtcctcagcataccatacagtgtctcagtttacctgttctatattcagcatctctgaatatattacaactgaaagtctcagaactataatattctgaagcaaaactaagcttagaatcttcagcatgttgaaactcatcactcatctacccttttgtttattctctatccatccatccacccaaccatccatccattcattcattcaggaaatatgtattgaatgcttacttaagcactgtcttaagatctgaggatatagtggtgaacaaggcaggcaagaatcctgtcataagagcttatgttttagcgcagaagacagtaaacaactaaattacaaaaataaattttcatagaggtaatactgtaaatgatatttaaaatggtgttgcgatgataactagaatgtggggtggggagaagactatggagctgagattaaaatgatgggagccagcaatggagaggttgggataagggtcttcaaggcagagaaaactgcaaaatacaaaggtcacgcaacagggttaaattccatatacaatcctctaggggaagattagtggtgcctttttatatattaatttagaaataactttgaggattatatgaaagcggtatgtgactacagacttgaaaattttaattcgttttactagtagttttcagactggcacatgtagtaaatagatcccttgttactgatgaactttgtgttgttgtagaaagtgagttggccgagcaaaaataaaactataattttgaatttgcaaaattatgctttaaatatttacttgctattattccttgtgaaataatagatggataaggaagttacaggaatatggacatgatctctcggtgatggttttacttactgtgccatttaggtgatgatgattcatccagtatacttttttatttgtggaggagacggagtcttgctctgtggctcaggctggagtgctgtggcgggatctcagctcactgcaacctccacctcccgggttcaagctattctcgtgtcttagcctcacgagttgctgggattacaggcatgtgcctccatgccagctaatttttgtatttttagtagagatggagtttcaccacattggccaggctgatttcgaacccctgacctcaagtgttccacccgcctcagcctcccaaagtgctgggattccaggcatgagccaccgtccccggcccatccagtatatttttaacgtctactgtgtctcataacgaagcaagaaataccaagtcagtggccattatacaaaatatgggagctcaaagtatgaaatcgtattccttgttctgcagttattatggagaagttcaataataacacacttttattgaagctcactaaattcatgaccggtgttagttatgtggcatagatggagttcccaatgtagaagtgagacagacacaaataatgacctctaccacaatattttaagtgctataataattataatattgccacagcgctaagggaatagagttcccctatatgttataagcctttatcagactttaaaaatttagcatctaatgggatttttgaaattcagaaattaagaatgattaacactttctacattgaggaggcattctcaataaaaacccaaatagtgtgaaatcatagggaactcatttctcattattaacatttttttaaatgtcatatcctctaatgataatacctctacccaatggggaaaaattcctttccttatgatctccttataatattatatttcctatgatagtatatccttatgatgttattttatagtaagtatccttagatgcttagcagaaactgagtgtaatttttatgaacctgtaaaatgggactcaagcttggagtcttaattcagggatatacatttacagtataggaaaggggcaattatgattaggtacgtctagaatgtgaaactatcagttgttagtatagtgaatgtgttgacaatattttcctcccagccttttccctgaactacttatatagttatagcaagatgatgaagttaaggagctgtgatgagatgagttctagaaacaactccatctatattgaaagttaagttaaaaactagtcactatcagataaatgtatttaatgactttttaagattaatctacaacctgagagtaccagaaaggaataattgggaactggtgaatgctttcaactgatttgattaattaacatgctaattggagactatattgttttacattttaataactgttttcacttattttttttagaaaggctgatactctgatatctttcaatagatttgggttatgtataatggtatatattaaattttatttgctggattttgtggaattgaatatacatatcttaactaggaaaattaataagatgatttttgaatgcttatcctctgggttaaggaggactagctaatattaattctaatgcctgaattgtaaatttaagcacccctgtcaatgacactttatgtaattcaagttcatattctattcaggtcatgagcaccagcactgtaattttttttttaaatgaggttgaggaaaatgttgagatatatacaacacaattttactatatcaattctgtgatcaagaatttttaagtgtgtagcactctgcacacatttttatataacaaaataaatattctatgcattattttacttaaattttttttgaaacattgtctaaaatggtctctttgtttattttatagggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcaggtaagtcgttcttatcatttcggtatgattcatacaatttgtagtgcatataattgtttgggaatataataagttttgttatttaaacctcaagatttcctgactaaaaatctgatgttaataaaacagcagcatctgattgtgaagtcgtaaacttttaaaaatatatttagttagttggatctctagtaatgtacaattttaagaatacaaatgttaacatagagccagaagttaaatatccacatttacatggaaatctatttgtgggatcagataattattatatatttatttataaagcaaattaagtatatttgctccatgattttattcttttttttttttgtgagacagagtcttgctctgttgcccaggctggagtgcagtggcacgatcttggctcactgcaacctctgcctcccaggttcaagcaattcttctacctcagcctcctgagtagctgggactacaggcacgcaccatcatgcctggctgatgtttgtatttttagtagggaaggggtttcaccatattggccaggctggtctcgaactcttgatctcgtgatccacctgccttggtcttctaaagtgctgggattacaggtgtgagccaccgcgcccggccgattttattcttttaaaacttgaaaggtatatataactttatgttcttctataagttttagatatactcttcacatatttctgtaattttgagatagcaaaaagtgaattattttaaccagtaaaagaagtgagagcattaataaacttctcaaaactctactaatttaggctattaactaactacaaaggattgttattaggttacttgccaatggtggattccagtaactgtggttcctttattaagcctttaaatcaataacacccaaaataaaatgttttataaagaaaaataaaatttcaataaaatatcaaaacattcttggccgggcgtgggggctcacacctataatccctgcacttcagggggctgaggcaagtggatcgcttgagtccaggagttcgagaccagcctggccaacatggtgaaaccccgtctctaccaaaaatacaaaaaagtcagccaggtgtggtgatgtgcgcctgtggtcccaggtattcacgaggctgaggtgggaggatcacctcagcccgggaggtggaggttgcagtgagcccatatcccgccactgcactccaacctgggagacagagcgagaccctgtctccaaaaaaaaaaaaaaaaaaaaaaaacaaaaaaacaaaaatccgggatctatttatgtaactactagaatcttaagttcagaatttactccataagagtatataaaaaacttactgtgattttatccatgtttttcctaatatataataggtctaagtcttgtacttttctgtcctgtccacagagccttgaaaataatttagagctcagtcattcagtttggatttatgtataaattgaaatatattaattacttatttatagtgcacttggcaaaatgcccagaaaattacaattttaaaacaacaaaaaattttttaaaagccagtgttaagatgtgacttatcttagagtatgataatcgttgaaagacgattgtcttgccatttcttccaaaatgctcctaggttttttgttttttgttttttgtttttttttttgagacggagttttgttcttgtcaccgaggctggagtgcagtggtgctgtctcggttcactgcaacctctgcctcctgggttcaagcgattctcctgcctcagcctcccgagtagctgggattacaagcctgcaccaccacgcctggctaattttagtatttttagtagagacgggatttcaccacgttggcaggctagtctcgaactcctgacctcaagtaatcaacctgcctcagcctcccaaagttctgggattacaggcgtgagccactgcgcccggcctgatgctcctagttttaatggtttgaatgaacaggggacgtgagttcttgagaacagtaactacggtggtgcatttttcccccctgcacgtaacgtacagcactctaccgttttgccaagcactttgtgctcctaaaatttctgttgcattgttgtttgaatgaatgaataaatgagtcttttaaaagtaattgtagaagttgcagcattaagaaataaagaggggggctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaagacaaaaaaaaaaaaaaaaaaaaaaaaagtcttgcttgtttttatgttagacttattttccgtgtttggatttagcttattataatgatactgttatctcttgctcaatatagtatttagtatttgattaattcaaatgagctgaagatactaatttgtgaattctaatgctcagttcaaacatttatgtgtgatttgctcttattactatgaatttatgttttcttaaaataagattatactgtgtttaaataaaccatttttgccaggttatctttgaaattttttaaaatgtggtgaagttcaatgattatttcatatatgatgtggtatttggatgaaattacaatttattgtagttgtatggtaaatggatgccagagtttctgtaagtttgatgtgctggtgtattatttattttactaaatgctctgttttatgtataaaaaggtaatttttaggacgttagggaaacagctcataggaatatgaaacttactgagtttaacacaaatttattcaaatgttttattaaagtagtttacaaaatcttaactttcctgtgtgatttttttttctaagtacatttgaaaaagcctttttgttttatatccttgaggattaatagtttcacttatccagaattttttcttttctatatataaaatacccagaacatatgctatagcctagttctaacaatacattttagtgtagattatataaattatgtgagacttttaaataattgaccattaacgaaagccctcagttacctatacactaaagatggtgtctttcaagatgctaatttttttacattagaggaaataaaaaacatatactttttaatgaatatatgttatattttatatatgtatattcatatataatatacaaatagaagaacattatttgtcaaattgaatcatgaaaactgcaacaaaaaaaaaatctcttaaatggaacattgccagtactccgtactttcaggaaaactttcagaaaatggcctgtgtcagtggccattagaaaaaccactaattcttgcctaagctttgtgatgcatatttttcttccccttgaaagtaaagaaattgtaaatggcactcttgaaaagcacagatgaataacatactataaacctgttacttaaattatcagacattttgaaaattctggtcttcataaacctaaaatattcggaaccactttttgttgaaaaaggttacctgtcctagggaaaatcatactgggggagaggcaacaaggggcatatatacttggaattgtggagctgaaagagtctagcagatacaatattcttttgtgacattaaaatctgatatttatgagtataattataggtcactcccataattgcttgagctgattcagctggccagtggatgcgtagccacttgtttttcctatactaggagcatgcggagggggaaaaaaactcttttttttttgtttgggaggccaaactgcttttgtccctgcaaactgatacactgagatatgtacacctgaatttaaggcagaagaccaacctctctcccatcctgtgaggggaaatgtcctctatctgtgttcgttggggtttttttaggcttttaaaattactcctcccaacgcttattcttctgaatggaatcgtgtgctttagtggattctgctgcaggtaagagatagcagtggaaaaatagtaagtaggtctagatataatgtcagtggaaataaaacacttttaggcagaaaatcactggattgttttatacatgtatatttagtccatgttaaaggtagcagatttttaaagttcattttgaacacccacctggcatgcatactttttcaattttgtttagactgggaatgacttggctaatatcccctttctccaaggtcctgccctgatagttagccacaccttttgaggataagatacaaatcctggggacatactattgactattttgggcagggacatttaagcctgaggaacctgaaaaacataattgatgattataatccacccaaggttttttcctatggctcacaggcttacgaaatgtatgtatttatattgaggttgattctaaattaactatgaataaatatatttgaaagtgttttcaaggccaatataataatcttactatggtcataattattagtgatcattttgttacttttacctactaaatttagtaatatttggagtagaagctgaaaaacataagttcttatattttttcaatttctgtttactttttataacagcaatttaaaaaatgtaactagcaagaattatgtttgttcctgaaacctttattgagttcctactatatgcatttaagtgttaactttaattttgataagcttaaattttattgacttctgaaatgcttattaaagatagtaatagttaacattttaacatttatttagtatttattatctcccaagtactgttctaagagtaggagttgtgtgtatgtgttgtgcgtgtgtgtatgtgtgtgtgtgtatgtgtgtgtgtgtatgtgtatgtatgatccctgtgatgcgtagatttacgttttcagctcagacctctctgtttctctctctctttttttttttgagacagagtcttgctcttgtggcccaggctggagtgcaatgtcacaatctcggctcactgcaacctctgcctcccaggttcaagtgattctcctgcctcagcctcctgactagctgggattacaggtgcccgccaccatgcctggctaatttttatatttttagtaaagacggggtttcgccatgttggccaggctggtctcaaactcctgacctcgtgatccgcctgcctcggcctcccagagtgctgggattacaagtgtgagccacccacctggccagacctctcttttgaaattgagactccatctccaaatgtcttattggatgacatataggcatttttaatacattaaaaaataatgaaaaattatgtgtgatatgtgttttttatatatatatataacacagatatatatctctatatatgtacacacagatacatatatctatatatatacatacagatatatatatctatatatatacacagatatatatatctatatatatacagatatatatatctatatatatctatatatatacacagatatatatatctatatatatattaccatgtatatacagatatatatatatctgtgtatatattagtatgtatatggcatttactacccctgtgcaatgttttaagacctttaaatgtacatatacaatcaggataacagtattgttcgtattttgtagatgaacttgaggctcagagaggttaagtaatttgcgccatattaaagttgcatgcccagcaagtgtcagtgttaagatttaaacccaggctttgtatctctcgagagcctaggcctttaacaactggtttgtacagtgtcacaataaggaaagtctattaaaatagtattctttcactgttgttagtattctttcactgtcatcacatactgaatattttgactttctttcattaatatttgtctgatttaaatgaaaaagaaactatgaaaactttcagcaaatgtgtagaagataatataaaaacacctttgtactcatctatcagcttaagagacaaaacattattttttgctgtggtagagaacttagttgaataacttgggagtttttttatgatatcgtaataccatttgggcctatattttcattgatttaaaagatcgtctgaaattctacattttctctaaatctatgcatgtagtttttgcaatataatatcttaagaatatatatcagtgtattgaaaagcctatttttttttctgatcacatagctgtgtgtaaattgggacttctttgccctatccattgtggatgatacttctagtaattctaacaccatctctatgatatttattccaatttgccatcatgtgataaattacgaaaacaattttttaacattaagagttaatttcctttggtaataccttaaattggagaagttcaataaatagcacttaatattatgtggtttgtttttacatatcacatggataatcctacaaaggaataacaaaactaaattccccttgtccatatggggcttatatatatggagcttacattccagtacaggaattcagacaatttttttaaaggtgtacatcaaatatcaggttgtaatatgagctgaggaggagatgttgctattttatattagatgatcagtgaaagcctccctgactttaatgacatttgcacagaggtctaaaggaagtatggcagtgacctatgttcactggaggagtaatgttgttagaaacggaaaacagcaacagcaaataccaaagatgggagcatgcttggcatgttctaggaatgtcaaggaggctagcatgctggaagcagataatgtagagccttattgaccattcaaaggactttggcttttactttgagtgagctgggacactgttagagagttttgaggaatggaatggcatgagatgacctacatttttaaaggatagccctgggtggaagcagggagaacatgttgtacattactcaggcagaaggtgccactggccacagaggtttctagctggtgaagtgacaccccaggatcctgtgacaatatgataaatcattctagttcttgatcactcctctgtggtgaccttggtccagtcaatggacctctttggtcctcagtttcttgatatgtaaatgggattggagccttccagctctaagcctctgtgttctgtattttcttttgcttagttttaatcctcttacctttgctattggaactagattagtgtttaggtattattttgaagagtgagaagaatgttcctctataaggctagaggatttcctaatgtttcattattttttgtatttataaatgtatttaaccacccccagacagatatttataatttcctttaaatacggatgaaagcagttcctaaaactctgttgcataactgtttttgaaacctggtgttcattagaacccacaccgttgtcctctcgtgggtaattctcctccctaccacagttttaattggtttctttttgttcagcccctcgtaaaatttaaaaatatatataaataagtgtacacacacacacatacgtatacatactaacagttttaccaaacatcctcaaaacagtcattttggaatattaagtggggtcatgaatttcaaattcacatggtatttaatcactcaggtgataaaggctctaagaaagtcattttggtatattattttctgctaaagcaaatacttaaaaatcccttttataagccctcattaactggtcctatctcagatcactctgttactgtacatttccctcaacatttattttttactatatacatttacctgtgtctgtttatactctgtaatagtttcatgcatgcatgtctgtttttctcatttagattttagtctcctctggggaagggaccctcttaccctcttatttgtctcgtggtggctggtactgtgtaatttatatatactaatgtgtgatttgatgtagttattgacccaccatcaataaaaacctatgcttctccaccagtgggaatgaatttgcattaatcggcactattttgtggccatgcatttttagctgtaatcagaaaaagaatgaagctaacttcttccacataagaatgaaaccttggtttgaatcatattcacaatccacagacaacatagcatgctttacacaatagccttgttacagttgcatggtgaattaatgaaattgaatgtttacaactctatttaacactctaaaaatccatgtgctttgaccgtaaagtaaatcccaatctgccatcacaaattgcattagactttgcacataccatggtctatgtgtgatttagaatgaggactctgttatttagagatttttgttcatatctctttactaaagtttatgaaaggaagcagtgcctgctgagaaatgaccaatgagtttggacagttttattcccagccaattcattgcaagatgtataggtatttggcaatacattttatgaagatccaaagaaatacgtagcaatagatcattgtcactaaggtttcccagcacatgacaaaaacagcaaatattgctttgaagaatagtatcacagaattgtgattgcctagaattcttgttagagttgttgctgaaattgcctcacagctttaggggtattttaccccacgaggaaattgttttttctgtttggttgggatccacttatctgccaaactcatggcatagtgtctgtattcacatcctatgatgatagcttcctcagccaatatttccaagccagtgaaaacataaaatatcttttcaagttgatacatgtgcagttatttgcattacctctggaatatttgtgtttatttgatgctatcttccctttagatttaaacatatttttctagtgtatttacaaatgtgcattttaacataatcataatgaaaatagatggatcttgacaacaatacaaattaggactagaaagcactttctgaattgtaggtcttaataagtatttaaacaacctgtattaaacttattaaaagcttggcaaagcggccaacagtacttagaaagttaatataaaggtaggtacagatcaatactcttagaacattttgcaggggactaactatgaaagatggaataataaggatactttttacaatgtagaaatgtgaacacggcttaaaattgtgagcacatctcataaagcagcattatgtgcggtattactaaagcaggtttttaaatattggtatttggaacttctttgctttcactttcaaatccataaatcattttagaatagcactagtatatttatacatacaatacgaaatggtaaactcattgcagttgtcaatttatatgccttttgttaaaatcttggtcaacaattcaaattcgtatcaagtatattcaggctcatttgactaagttgataccatatatattaagtgacatggaaattttaattatatactattagcttcaaaacataattctgacttcggcacatgcaatgatattacctcttaatagaagcaaagtagatttatgtgtcatacattattttaaaaaagaattaggcacagcaaatactcgagtttttgaagtattattaggagaaaatgctacaggcattaggataaatagtggttcttgtgttggatttattttattactatgtaagctccaccaaggcaatacattttctcgtttaaatgatgtgttttaaactagaaagccaatttttatataataatcatctaaaataattagaaacatgtaactggtcatataaaggtatgtataatctagcagcagaatctaggcacactgattatatggatttctgagtagaagcctaacttccctcttaaaacacttatatgcattttctacttattcaaaattagtcttgggaagaaaatgcttataaatatgtcatttgaaatatatttatttcgagttatatgaactaatttaactaaaggtcttgggcacatactagagttttaatacttctctcattattttgagaatattgtaaaagtagttgcagcttaaaataaaagaagcagatattctacttccgtaagacaaaggtaaaaatgccaagctccaattaaatgaggaaaggaggtggaacttttccaaaaacttaggacaatgtcaggtaatgatttgagtataatgtagatccaagtttctttgtgtggagtggagaggggtcggggggtgtttatcaggtaaacagttctgtctctcagtaaaagtctctcaataaaaagagagacatagctgttacctgataaacgacattgcatctcttttgtgttgttgtttgtttgtttttcaggagggtcattcttcctaattctgaactcattttattttgtggttctttaaatgagggatattggacaacaacagtagaatgagtccttgatagttttccataaagtacagaagatttctatgaatgtccatttcctgcatttagccaaaaagtaaaaaaatcaaggttatgatatttctacaatgaccaggaataatagtactggaatgcagctttctagtaatctaacctgctaccaaggtgtacttgagaaatgcccctgaggctctccccttggactgtctatcatctcagctggacttttgatagaagttggatagctgacaactcacaattaagatgccagctggcacctggagtgcaagtagtctgtatagttgattgaaagaagatccatgtgcactagataacagtatttgctctatgaccccagctgttcgactggtggtagataatggacagctaatttggggagatttgccacctggtcagcaaagctgtaagtgtatagcctctcacaccaggcagtttaaacctggaatcttctgttaagatggaatccatgaaggcagaatatagaagataacataatgttatagtacttctaaaaactaaaacatcttcaaatgagacagttttggtgacctcttatatgaatatgaatttcaagcctttcatatacccgaaatcaacctactcctgttaggtcagttctgcagcatccagtgttattgaacatatgcagattgactctatttctattttggaggatattgcctgagtactgagtactgctacagtttttttttttttcttttatgtggtaccatacttcccttgataccagcttccaaaagaatttcctggagatcatatcttaaattggtacgttcaacatttattcatcaaaaactattgaagattggagtgctgtagttaaacacatttttaaaaattgagttataaatttccatatgtgaattaatatctgtcaaagaatatcttgaagtggatacagcactaaaactatattaagtattaatgaatttttcttcgatatagagaatgcttaagaattttatagtgcctttgaggttcgcattatgagcatttattaagatggtataatactttaagtgtaagtggtgtgggacatcaagctgggggtattctctgaccttgtgatatgctttggatcttcaaaaacttttctgtcagtttatgtgcttgatgagcaatgatgttgctttctcctgggaaggagatgggttattatgtgggtttatcattaattttggtttctgttaccatttttgtattgtttgcaaattataatgatttatctgttgaaatcatgtgtcttaatttgctgatgaccatagtttgattcaagtattcaccttattgcatttcacaatgtgcttagaaagttggaatgataaaagttaagaataaatcgctatagaggagttcatttggggagcaggaaaaaatcgcatatacagattagtttttcttaatttttttttttttttttttttttttttttagtttatttgtttgttttgagatggagtctggctctgttgcccaggctggagtgtagtggcgcaatctcggctcactgcaacctctgcctcctgggttcaagcgattctcctgcctcagccttccaagtagatgggattactggcgtgcgccaccacacctggctaattttttctatttttcgtagagatggggtttccccgtgttggccaggctgttctcaaactcccaacctcaggtaatccacctgcctcggcctcccaaaatacggggactacaagcgtgagccactatgcctggtccagactggtttttaaaatacgtgactggaaagttctgaatcatattgatataaaggatattagataaatgtgaattatcaaatagcactgtggagattacaagcattatgctggacacatactgcagaggtctatataagcatgatattgggcttattaatctgtgaactcacagctgatttggaatcacataataatgttccactatttaaaataataatccttagtatattctttgtcttagaaaactcatccatgcattcaggatcttggctctgatccttgtgtgtatgatttagcatctttgatattcctcgtatgtcacatttgctcattttttcacttgtgatatctaaatggcttttacatttccattggcaataatctagctcaggcctcactccatttggagacaaaaattgatagaggaagtgattggtctggcaaaacatagttactgggtttattgaaaattcagtataaccaaagtgaataaggtaaagtgcaaaaggataatgaagtcaaggaagttagtaggaagcaaccccaaaatggctgaccaatgtctttcatgttgagtatggaagcaaggaagggttaccaaggactgttattcccaaatgaaaggcgagtggctttattttttcaaactgattcctaatatttgtgaagtattttgtgtcagaccaaataccaactaatagttactacattttttgaagtgggtatttacaggtatatatcattgacatgtctacagccaatagtcataaattgtaatatgatagggctcagtattttatctattggtacatggaaaacagaaagaaagtatattttttggacatctctgatgtttttattatctaaagtatcctgtgccttgatgatgcaacccaaaattaataattaaaaagatgaaaaccacctcattggtattgtttttacttctacatataaccattggtgatatttttaatatattaacttttatccaatatttgttcatgaaaggaaaataaaatcttgtaacctctaattaatgatttttatgttgttgataatatagtttaatgagagtatataagaattgagaagtgctggattctattgttttactattaggaagctctgtattctaagataagtcactaaccttctttagtttcttcatctacaaaatggagtaacttattttatttcacaaccagaaaagctactcttattggtgtgagttctttcatggaggtttgtttgtaaatgaagaaaaatccatgtttttaattaaaattatttgtttgttttggcttttaactgttccaattaaaaagagagtctttgttattttgaataaggccaaagttatttcagcaattaagacgtgctttctttacaaagcatttatatgtttgaaaagctttagcaaggataaatgcatatcttttaggtgtagctatatttctagagttttctgaaaataggtacaagtcaggttgacaataacagaaggctgatatctcttagggactttatactgcatttagtcctacaaatgctttgtttgtatgtcatgtatatatttgttatttttgtgttgttattgctttagatggtttatttcactataatataagaaaaataatagcagatttggcttattttgtcttggataaaagccttaacaagttgtttagtgggggattattaaggattttgaatattcgttgtatttatgttggtcaaaggatacaaaatttcatttaaacagaaggtgtaagttcaagagattcatcgtacatcatggcgactgtagttaataccaatatattgtatacttgaaaattgctaagagaagaaatttttaaaagattatttttaaaatttcaatagttttgggggtacaggtggcttttggttacatggatgagttctatagtgttgaattctgagattttagtgcagacatcacccaagcagtgtacattcattgtacccaatatgtagtcttttatctctcacccacctcccaacatccgcccacttactttgagtaatgatggtattttgatggaagttgcaatgaatttatagatagcttttttttttcaaacaggtcttagtttattccaagttttacaaagtcaaagttgcataagtcttacaaagtcaaagttgcataagtcttacaaaattaaagttgcaaagtgaatagtgaagcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccgcaatggttgaaccagtttacagtcccaccaacagtgtaaaagtgttcctatttctccacatcctctccagcacctgttgtttcctgactttttaatgattgccattctaactggtgtgagatggtatctcattgtggttttgattttcgtttctctgatggccagtgatggtgagcatttattcatgtgtcttttggctgcataaatgtcttcttttgagaagtgtctgttcatgtccttcgcccactttttgatggggttgtttgttttttttcttgtaaatttgtttgagttcattgtagattctggatattagccctttgtcagacgagtaggttgcgaaaattttctcccattttgtaggttgcctgttcactctgatggtagttcttttgctgtgcagaagctctttagtttaattagatcccatttgtcaattttgtcttttgttgccattgcttttggtgttttagacacgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgcggcattatttccgagggctctgttctgttccgttgatctatatctctgttttggtaccagtaccatgctcttttggttactgtaggcttgtagtatagtttgaagtcaggtagcgtgatgcctccagctttgttcttttggcttaggattgacttggcgatgtgggctcttttttggttccatatgaactttaaagtagttttttccaatcctgtgaagaaagtcattggtagcttgatggggatggcattgaatctgtaaattaccttgggcagtatggccattttcacgatactgattcttcctacccatgagcatggaatgttcttccatttgtttgtatcctcttttatttcattgagcagtggtttgtagttctccttgaagaggtccttcacatcccttgtaagttggattcctaggtattttcttctctttgaggcaattgtgaatgggagttcactcatgatttggctctctgttcgtctgtttttggtgtataagaatgcttgtgatttttgtacattgattttgtatcctgagactttgctgaagttgcttatcagcttaaggagattttgggctgagacaatggggttttctagatgtacaatcatgtcgtctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagataagtcccatcagtacctaatttattgagagtttttagcatgaagtgttgttgaattttgtcaaaggccttttctgcatctattgagataatcgtggtttttgtctttggttctgtttatatgctcgattacatttattgacttgcgtatattgaaccagcctgtttggcagcatggtcattttcacaatattggttctacccttccatgagcatgggatgtggttccatgtgtttgtgttatctgtgatttctttcagcagtgtttcgtagttttccttatagagatattttgcctccttggttaagtatattcctgagtgcttttttgtttgtttatttgttttcgttttgcagctgttgtaaagagggtcgagttcttcatttgactgtctgcttggtgccactgatttgtgtacattgattttgtaacctgagactttactgaattcatttatcagatctaggagccttttggatgagtctttagggttttcttggtatgcaatcatatcatcagcaaacagtaacagtttgatttcctcttttccaatttggatgctctttatttctttctcttgcctgattgctctggctggggcttccagtactatgttaaatagaaatggtgaaagtaggcatccttgtcttgttgctttcaacttttacccattcagtatgatgttggctttgggttggtcatatatggcttttattactttgagggaagtcccttctgtgcctcggttcttgaggatttttatcataaagggatggtggattttatcaaatgctctttctgcatctattgagatgatgatatggtttttgtttttaattctgtttatgtgatttatcacatctattgacttgcttatgctaaactattcttgctaaactattcatccctgggatgaaacccacttgattccgatatattatgtttttgatatgctgttggattcagttagctagtattttgttggggatttttgcatcaatgttcaccagggatattggtctgcagttttcttttttgttacgtcctttcctagttttggtattacggtgatactggcttcatagaaggattcagagaggattccctctttctcttttggaatagtttcagaaggattggtaaaaaatttttctttgaatgtctggtagaattcagttgtgagtccatctggtcctggagtttttcttgttgacaatttttttttattactgattctatttccttgcttgttactggtctgttcagagtttgtgtttattcctgatttaatctaggagggctgtatgtttccaggaatttatccatttcctctagattttctagttttcgtgtgtaaaggtcttcatagtagtcttgaatgatcttttgtatttctgtggtatcagttataatgtctccagtttcatttctaattgaggttatttgcatcttctctcttctttctttaattaatctcgctaatagtctatcaattttatcttttcaaagaaccagctttttgtttttttaatcttttgtatttttttttgttgtttgaatttcatttagttctgctctgatctttgctatttcttttcttcttctagctttttggattttgtttgttcttttctttctgtttttttttttttttttttttttttttgagacaagggcacccaggctggagtacagtggttcaatctcggctcagtgctgcaacctccacctcccaggttcaagcgattctagtgcctcagcctcccaagtagctgggactacaggcatgcaccaccatgcccaactaatttttgtatttttagtagagacagggtttcaccatgttggccaggctggtctcgaactcctggcctcaagtgatctgcccgccttggcctccgaaagttctgggattacaggtgtgagctactgcgcccggcctttgtttgttcttgtttctctagttacttgaggtgtgacattaggttgtcaatttgtgctctttcagactttttgatatagacatttagcactgtaaactttcctcttagcactgcttttgccatataacagaggttttgataacgtgtgtcactagtaccattcttttcaaataagttttaaatttccatcttagtttcattgttaacccaaaaatcattcaaaaccagactaatttccatgtatttgcatagctttgagggttccttttgcagttgatttccagttttattccattgtgttctgagaagatgcttgatctgattttgagtttcttaaatttattgaaacttgttttgtggtctatcagatggtctgtcttggagaatattccatgtgctgatgcgaagaatgtatattatgcagttgttgggaagaatgttctgtagatttctgttaagtacatttgttctaggatacagtttatgtctattgtttctttgttgactttctgtcttgatggtctgtctcgtgctgtcagtggaatattgaactctcccactcactatgttgctgtctatttcatttcttaggtctagtagtaattgttttataaatctgggagctccagtgttaggtgcatataaatgcaggattgtagtatcttcttgttggtcctgagagaggagatttttaagtgttctcataacaaataaaatcaagtatgtgaggtaattcctgcgttaattactttgatttacccatttcacagtgtatgcatgtgtcaaaacatcatgttgtacagtataaatatataccgtttttatttgtcaataaaaataaatataaatttaaaaaaacacatatttaaccatggttaagaatgtatgtatgtgcacactgaagaacatataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtgaaaaaaaaaaaaaattcaccaatttctctgctgcccactagaatcagatagtataacatacaaactggtttaggagaaaagaatatgtacaggtggtatatgctaatgcctctatgtttcttcattgcattcaaataacttcttactttattcatgacataaacttggtatgagctctgtttcatttgcagggcttatggattgggaatgtgattttttggaatacgtttactttaacaaaattccacaaaactaaatgaaattggacatcctgtggtgtgcatgatagaattttaactatattacttatcttaggaaaataaaccaatacatttttcttgtggaagttaacattttattataagtttgactggttatgttactaagaaggcatctttaataagtgtcctaacataattatatctactatttcaaacatctgaagaagatagaaaatgtgagtagcttttacttgaatatttggaatactctttcccttcgcttcccttattgaccgtagattgaagagtctattttcattgtcattcaaattttttggtaattttttcctcatcattactttggaacaagaccttctcttatacttttctaccaataatgtttaaaggaaggtggggaggaaaatattcttgattgttagcctgttaggcattcagatagatttgggcataagccatttcttagactatctccaaagtaacttagacagcttatgaaattgattttaataaataaggaacttttatccttttagagagtgtttacttatactgttgccctcaagagatttttatatgtaactagagcatttaaaattattttgtaaatatgtaagaggaatttgtctttatgcaatataaacagctagaaagaatgcacatttcctactttgtaaggaactcctaaaaatggatgagaggcatgaaacatagtaggatttttgcagtaagactgatagaataaacgcagccagagagaaagatggaatgtcttctttggtgtttctaaggcaattgtaatctatcacaacattgaagtcaaaaccactcagaggtagaactggtaaactgatgcattcaaactttctatgagtcacatgaaataaatgatcagtgactgtcaggcttcgaaggtttatgcacaaatgtctgaaaatggtagtgttacgtcaaatagatattttataattggtcagagatatctcatggattaatctactatgatgaatagtttccaaggacattcaaatgcccaaagctattgtgtttgctttcatgtagagaaacctgagtggacgtatatgtttttatggatctaagaccaagtcagttgtagtgtacacaaatccacgtatatattatacatgtttatatattttttagtgggtatatatattgacagtgaaactgtttatgatgtttatttagccgaacaaattttccttttaagatgcggaaaatactaaggtttacttggttactgtttatgcagatttgatccatggactgaatatgtgatactgtttatgttgggctacatactggttttaatcacatggaactctttctttccttaagtgtatgcaactaaaatttggttttagttgcattaaaaaacattacagtagcaatattggtgtttaagtgagatgttttcctattttaaaaaaaacaaaccaaaacccaccactcaagataacatttaaagtctcctcaaccttttgaattagttgtttcacatgttataattttaccaaatttctgaattcccccaagaaaccctgaactatcattcattttatttgatgttccagtgattcaggttgtagtttgagattacacatgggaatagaacaccattagagggaaataaaatcctttgtacagaacacataaccctctatactagcctttagcactgcacaaacagtgataaagggatgacatgactaatattggactccttcacatgagaccaattgcctttacagcttatgggattcagtatagaagtttctaattttagctttaactcttttgaaagagatgttaatttggataatctaatcattgatggacatgcagtcactattttctattatatcttcattgtatatagcatactgaactcatctgttcattacatctttggttttacattatatttaagtgaaatgtaactaaataattcagagtctgaatctcaaatttatgggagaaaggttgaggttttgggaaactgtgaaatgttgtcctttataagaatctatgagggagcacagtcttattccctccttcaataggtacatttatagaaaattttcctcgttttgctttgccctgaagagctagagaggggagaatcttgctttctcttagatttagggttaattgaatcttctgataccttcattaaatgtaagattttctttcctttgatcatgctgatcagtataagtgggtcctttaaaaataatgaccttagaagttctaaaggcttgagataggtttctgttttaaaacttcaatatatttttgatataattctgtcaggattatacatgaactaaaaattctctccccctcaccattataatttccatatctattctgatgtgaattggccagcactaaatacaattagaattaagtatacacaaaattggatagtgaccagttaaaacacatgaggttggctgggcgcggtggctcacgcctgtaatcccagcgctttgggaggccgaagcaggcggatcatgaggtcaggagatcgagaccatcctggctaacacgatgaaaccccatctccactaaaaatacaaaaaattagccgggtgtggcggcaggcgcctgtagtcccagctactcgggaggctgaggcaggagaatggggtgaacccgggaggcggagcttgcagtcagccgagatggtgccactgcactccagcctgggaggcagcgagactccgtctcaaaaaacaaaaaaaagaggtaatatgagtaccaaatatttaaattataaagtctggcctcaaactcttgggctcaaatgatgcccctgtttcagcctcccgaatagctgagatgacaggcatgacactgtgccccagtcttatttttaaacaagtcaatagagtaagtttagtataattttagtcatctgcatgttttgtaaaaattaatataattttcattaagtgattaaaagttgtgttaatactgtggaaaaggattctttaatttatgcctaaaattcatactgcattttggactagaagattcaaacaacattcagatttttggtttttaacattttccaaaaatttcttaatggctttattgtgatgttttatatacattatttcatttaatagtcacaaagacttcatggggtataggtagtattctcatccctattttgaaaatgcaaaaacaagcttagaaaatttacgtatattatcaaaagtaacacaactagaatatgtagagatgagattagaacctagatctgttttcctctaaagcttatgcatttagccatgcagctatgtggccccacagcataatccaatgatggatgatggaatattttctttatttttgggtgaacttggaaaaaagtctttaatttttagctttttgagcagcgtaacagatattagcctccctgatagatacagccaaaccttttttacatagggttggaagatgctgtctcactgtgattcagacctcttgttcccaatataagcttcctggcttcctttttagtctccagatataatcttggctgctggttcactcaaacattaatcttcctgactggtctattgtttttgtttgggtggttcatttgttccacttggtctcctgacatgtgaccacaaatgtcaacttggatgtgtagcatgttaagacagttctttaacttaggtaacttataacacaaaatcaccaatatgttaataccttaaaaagtgagatcgtggacttacatagcccatccaaaaagaaatagtataagctacattttggccctattctttctgataaactaccttacctaaatgttgactgaaaattttagctgaagtctccagttatctgtccttaacagtattttgtagatttcttatgatgctcaggactttacttatcctatctaaataaatgaactaagctgttaaataatgaaacgtatgtttgtctgtctaggcatagatatgtagatataaaccgttctgtaacaccactaattcttcttaagcaaggtattagagctattagctagatgttatagaaaattgtgtaccggtcctcttttagtaatttctaaggatgtggttgaaataagcatgtgcttaagagtcagatatggatttgaggcctagaactgctacttacttgttgagtgatgtttgggaagtcacttaactactttgcttctcagtttctttacctagaaacaattttcagaatggctaaacttaaaaagactgacaaggatttggggcaattagaactgtgatattttgctgaaggagtgccaaatagccactttggaaagcagtttttaaaccgttaaacatctacttaccataagacccagctgttccactcctagatatttttttaacagaaatgaaagcatgcttacacagataacttacatgtcaatgtttgtatcagctctattcataatcatcaaaacctggggacaactgaaatactcatcaaataattaatagataaacaaattgtggtatattcatacagtaacaaggaatggaatactaatacatgcaacgaaatggttgaatatcatagtattcatgctaagtaaaagaagccaaacacaaaatttgaaaactgtacaattcttttataattatattctggcaagcacaaaactatagggacccaaatcagataagtagttgccaggatgctgggagtagggaaaagggattgactgcaaaggggaataagggaatattttagggtgatgaaaacgttttatatcttatttgtattggtggttacatgactatacatttgttaaaatgataaattttactatatataaatcatacctcagtaaaaaggaaagaaaaaataactcatgtttgggttggttatgaaaattattaagagtaattttcctccgtttttccttctgtttggttcttcattattctctgcctgttctatgtccctcataaatgtaaggtccatgagaaatgtcagtttcttatttcagggctgagatagtacagaaaaatttatgtctttgtctgtaatctctgagtaagattttaaatcaggtcatcaactgtattcttatcattctagatgttccagttagtactaaataattcagagctggaatttgcatactccatgaaatataccaaatatatctgtttcaactggattccttttttttgtttgtttgttttttttgagaccgagtcttgctctgtggcccaggctggagtgcagtggcgcgatttcagctcactgcaacctccgtctcctgggttcacgccattctcctgcctcagcctctccaagcagctgggactacaggcgcccgccaccacgcccagctaatttttggtatttttagtagagtcagggtttcaccgtgttagccaggatggtctcgatctcctgacctcgtgatccgcccgcctcggcctcccaaagtgctgggattacaggcgtgagccaccgctcccggccctcaactggattcctgatctgtgttctgcggcactgggagggcacagtatggttgggagggcatgtaaagcagccttgagttctgagcctgagtcttgcctgagaaaggcttcccctgcttctcagcaatccattgttccctgccagtggttctcaaacttgagcaagcatcagattcaccaggagaattagttaaaacatacacttctatcttcctcccagctactgattcagtaggtctgaggtagggcacaagcattttgatttctaacaagttcccagatgatgtcaatgctgctgatttggagtgcacactttgagaacccttgatttatgcttacttctagtgtttcaatgtcagaatttctgcccacatgctcacatacaggagccaacattttgtttttaaactgcctcctcatttcatgaccacttttgtattggctgaaatcagtatactctatgtatatgagaaagggaggctgggggaggggggtggaggagaaagagagaaagagaagcagtaaaacagtaagtgcttggctggagttcacaaagtgtttgatgtctgaaaggcagagaaatggtggtgctggcaagagaaaaaggaaacaaagctatgtctagccacacctccttccttttaacctcttgcgcatcgtcatcgttcgtaattattttatccccttagcaacgggctcatttcaggctcccattctctctactttaaaagttttaaagactcttactaggcctcctctgcccattggcctaaaatattctcatttaagacttttccctgtctagcttgtaataataggtcctgcctcctcacacttaagttgtatgattgtatcttattttttttaagaaaaatagtaattttccctgaataaaaccaaagtaccataaactgcatcatttgaaacaggggatgtgtgggcgactgatttcaattgaacaaatatgaatcatgttcttgtgaatcatgcttccctacaccaagaaagaaataaccctaataattttaatagcagtagacataaagagaatataagtaaaattcagaattttagaaacaatttgtggtaaatttaaagaaatcatggattatttcatcttcccaaataccaaagcggatattgaggactatatataaatttgttcagaattcctattatgtaaaggttattgcagggtacagtgtgctgtagtgatatctgctgatttttctctgtgataaattatatattacatattatttaagtatattatacttaaagctgatgtccctttatccctctaccaccacctcactgattatcgaggctttagagaaaatagctggttgcactagatgattacatgcctcaattggatagtagcttgttgccaattatcattacagtgccatattgattttttttcttgtttccattatggaaattaaagcagaatttgtttaaaatgagcttctatgtatattgtggatggcgattggttctgaatatgagctattttaaaaatatattttcttcagtggtgtgatgtctctgatattcccttaaaaatttaggtctctgctttgttgataagatttaccttaggtagctatgaaatggataaagactggaatggaatggtttaaatatagacagcatagatgttattatttcacataagtctatatattgatttatgtttatgatgttcttgggtagtatgagattgcttattctattaaccatacagccagtaaatttaattaaatttaaattagcaaatacttacttagtgttggctctatttaatataaatatttagtggctatatatgagctaccttgctaaacactatgaaacatagaaatattaatgaaatgatataactatctttagagaatttacatgccaaaggggtaggtaagacatggcaagaatcattatgattatgtcaagcagtaagagataaatattacatggagattttgaggaaaaggaactcatttgatcggaggaattacaggggaaaacattaatgacttaaaacagccaattttagttttaaatagttgggagaaatggagttgaggttactttctgggaagaaagaataaatgagctaacatgaggaagtgcaaggtgggctccagcaatgataatttgtctgattttattggcacatgtgtcttaaggcctgaggctggaaaggtagattgaggctacatcagaatgttgagccaaatgatttaaaatgtattaagtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaatatttttttattattttttttaatttccagggtacatgtatataggcgaacatgtgccatggtggtttgatgcacaaatcgacccatcaacctaaataataaacccggcatgcattaactcttttccctcatcatcttccccaccccgtacctattttttacttatgtttctgctgtactaattaattgtagactagttattacaggcttataaataataagtgtttataaagttttacagtgaggttaaatacacatttgaaaccatatataaaagataaatttgatgtttaattttccaaaatgtgagctattgttagttttctcgatttttttttttttatttctatgctgatatttcattttaaccaaagaagtcctcacagcatccagaggatttcagggatgatataacttctgtagatctaaatcttttaaaaaatggagccctattccaatgtttcttctattcaaatatattgctttcatatagggaagatagataaaacagtactttccattgtctatgctgctaatttcctcaggagggtgagctagtcaatgaaacaaacaaaaaaaatgattggaaaaagtgtatttgactcttgtctataatttagaaatgctgtgtctgattcttattctgtttattcctccaataatttctttcatgtgaacagaggtctttttgattttatagtatactaaatgttcagaaaacataacaaaaagaaagaaatgaacaaaatagtgagtgcttgttcagtttacaaaagggtctttatgatgtaaatccttataatatttaagtaatacttacatgaaagttatactttgcttcacaaaatatttattggtgggtttttgaaatcatgcaaatgaattagtgttgttcccaattttggtaataatgctttttctttaatggtagtaggaaaatttaaatgtcgtttgttgaatatgtttccacacagagaatttctgttctattgaaaaggaaaattatagggatgggttgacttatttgctaagaacattgtaagattgagatttctctttcttttatgttttattaatgtcagcaagtttacatacatataagacatctctgaaaaattgcagggctttttatgtatatgtataatactagttgtattataagggaccctgtgaattttagacaataatttttcttctaaaaatagactttactcaggttatgaagttacagtattttttctataaactattttttttactgtcttagaaatgacctcttcatacctatagataaaatactattgactaattcacttaattacctaattccctttacatagtattttaataatctcaaaatagataatagaaataattacaacaacaagtagaagtttgccaaatgtaaaatatggctattaataaccaatgcaataagattatatattaatctatagacagtctcaagcatatggaaatacatataagtatttatatattatacatacatgtatcagcaaagaatgttactgtatgagcatatgcaatgaatgcttgctagtggacatgagactcctgaatatgctagttgtactgtttctggaagtttcttacagaaatattcccatcactactagtacagattttctcaaaatctgggctcttagtctttggctacaaagttaaacagaatctgatgcccaacaaggaaataatgagcattgcttcttcacagctcaagatagatctctttcgtcaattgagggaaacaatgacataatggaaagataacacagttctagaattcaggagatatatatagttcatgctttgttcctaataagttgtgtggcctttggaaaattacttgacctctctgagtatcagtcccctcatctgtaaatttagctataggacactttgttctaaattcttattgactcatgttgtcaattgtcgtggcttttcaggatgctaagtaattttaatcaggacagtcactagagagagtcataatagtaagattcttatagagccctttttttttttaacagaacatactttgatttgtcaacatttagtttcttaagagtttggcagtttcggaaagcataatgatttgacttagattattcgaaattgatgtttttagttaggccacgttaatgtcttgcacataggtgctcagagcatggattaatggatcttttgaattatagacatgtgaaacaataggcataaaatatgccttcagaatagaaaatatgcagtgatcttttcacttcatgttggaataaattgtccagatcaaggaattaagcttttatccaaaatgacttacacatcaaattttttggccccatggagtttagattacctacttcaaaaactcctttcttttatccaatacatgtaacaataggatcataaaaagcaacccattgtttcttaacttccagtactataatattgctctgatgtttggattaatgattttccagatatatttttcatgtcttcttttttatttttgatgtgtctctatatattaaaaactacttataaacattaagtaaaatttttaaaacctaatgatttcactctcagtctcaatgactcataaagctattaagtttggtaattgcgtggtcattgtctctcagttttgcaaatgtgtttttcactaatattcattacttttaatcatctactggccacctttatacatacttatctattttgtttttgttgcttctttcaagacttgtttcttgcattttctttttttttttggtcttatctccatatattttcctatttattatgacctgtgataaactcacatttaagagctttagctatgttccccatctgccactcggagttcttttagaaattaaattagggctgatggaactattcatatggttggtaattaactgaagtttagctgaaatggaaattttgctccgatgaaatatccaatttcaccattagactgtaaaatgaagcaaaaatattttataagaaatctgaaaaatactttgtgggacaaagataaaataatatattgctttcttaatgtaatgaaaactcaagttttagactttcattagaatttctttacttatttattaagtgcgtgcatgcacacgcatgcacacacatattcatgcttagaaaataaatgaaaatggtgttttctctccttagttgacttgtgacacttaataaaacccaggtgccatttctttaggttcacagcttttgtagtgcagcacagctgtctgaatcagggaggataagagagagaaggcatgggaatatccatactgaggcttatactggcatatagtattcaaaagagccttttaaaaaaaatttctctttttcttcaccttaatttttcatacaaacatattggacaatttaaccacgaattccagacatctccagggagacccagtgacataagtagaatcttactttagaaaatcatatcagtatgcgctttatatgttattctttgttgaagaaatactgattgttcccatatttctccaaatttatggaatttttagggcaggctaatggagatatatctgatcaaggagcaacaactccaagatgcagtgatttcatataaaaaacaaagacagataactgcatttgaagaatattcatataattaggtagaacctcattgtgggggtatgggtttttggaagatcattgtacgttgcttttttaaattaaagatatattccatagacattctgaatgaaggttttttttttttttttttagtttggattacaaaggattctaggagatgaaagaagtcttttactattggcaagagcaattgaccccaaacaacccaacatgatgactgaaatagtaaaaatactttctgctatttgcattgttggagaagagaacatgtaagtattgctatattattatatttgctgcatggaaaatgacacttaagaaattaataagtcctacttttgttctctttctttggataactttcatgaaaacagtattttagataatttttgattgaaatttttatcttgcctgtttatattttggcttctttgttgacattatagaaactcagtttaaacagataaaatcctagtgggaaattcttgaaagttggattcaaagtgattgagcagaattttgttttgctggaggtacagcaatcattagaaagtggacaaaaatcagagagttattttggcaaatacacacacatacatacacaaatactgtgctgcatatcacacaatttgaatagatgcctttattttacattatcttataatagtattttactttatatgccatggtaaatgaaaattatttgtaaagtgaaataaacccacctgttagaaaaaaacggttgttgataattattcaaagtgtatatgtgccaccaaatgcagcaagttgttgctgaacatgcatttgatcacatcttcttatggaaataatattgaatcagaagcaaactttcagatttgatgacattaataagtctagtttgtaatgaacccttgtgataaagaatcaaatatctgctaaggacccgaaccaaaatatttccttggaacactttgcgtgacagtaataatgtcaatttgagtcagaacaggactatgcaaagatttaaggatgttggaatatgttgactttctcataactgttagagtaaaatgagatgttgcttagtgttagctactgtcctcagaaaccaaaagacaaacactaaacaaaaatattatcatattaagtctcacctcaatgataacaaactgagaatgagataacatatgtaaaagcaaggatccttaggattttattttttaaaagtcagtttatacatgtgtaagaaatattttttaatcacttagattttcaatattcataaaatacaatgtagtccagtataactgttatgatttaattataatttcagatataatttgataagagtagtatactatatagagattaatttgttttaggcattgtgtggagataccaatatttttggtcaggttaataagtttcttgtgctagataattatacattcttctttaatcacctgggctttcctttttagagtcttttttctttttccattgtcaaaaaatgttgattaaaaaaattctttaaaaaataatcactctttccagaactttattataaaattacaatctgtttatgctccaataaactgttaacaattataggtgtcatattatgtttaagtgatattaatgttaacacatgaaatatcaaaacctgaaaatttaaattttaatgtttatcacttaagtattctttttttaatgtcacccagaaaagttactttccttaagatttttaaaatcgaattttccttttgatgccctaaaattatttagagctatcaatatttgccttaaagaaatatacggacaggaacacaattcctatattgtaatggtctttcagttagactggaggaatcagttcaagaaatctattttatgtgatagtgactgtagttaataacagtgtgttgtatactcgaaatttcctaagagtgtatgtagactttaattgttcgtaccacaaaaaaatgtaagtaggcgaggcaatatatgttaattagcttgatttagccattccagtatgtatacatatttgaaaacatacaatttccatcaaaaaagcaaatgataatttttaaaaattctaatggtatatataaacatcaaataccagaaagaaaacagggaatactgaaaggaccggtgctcatagtgtctgtataagaagtatttctcatttctgtttcttcttttttctctacagtctagataaacttttaggggctataacaacagcagcagaaagaaataacagggaacgattttcaccaattgtggaaggtttagaaaatcaggaagccttgcaattacaggtgagttagttttgtcttaaattgcttctagagttatatttagagtactcattttgtatgacatcaactccattttagctggcatttaagtagtatggaatgtaaaactaaaattttttctgttgctagtttgtgagaattgcaatttgtttaaaattaggaaaaatacttttgaattattataaatgtggcagttatggctgtcattgatatttagacaagaatttagtaattaatgtaataaaccagggaaattgaagcctcagcagtaactaaggtaaaagggcaagcagttcagccaatgccattatcctaacaagtgttagtgaagtcggtgggcttgtagaaatgtaagacaattaaacacatctctctttgtgccattcagacaatattcaaaggtgtgactcaccagaatagaagggattgaattgcaattcttaggttagcgttaatttgatagccctgtgtagacacaacttactaaatgcctcctttagaaaatgacaaaactcactatctttacctagatggtttcaggaaatgatccattttatgaatagctctgttcttgagggatgagaatgcatatttattggctgaacttatggtatgaagtcctgcactaaacattttaatttgcatatattatttgatttaattctcacaacaacctagatatgaaggtattgctatagtatctttgttttgcttatgggacgaataagttgaatgagattaaataactggtctaacgtgacacagtttttaagtgtcacagtcggaatttgattccaggtttttggtctctgctaatctctcttttagacaatgcataccatttaatgtaccatggaaaattctctgaatttttttttagttctcatattgttgttcaacaaagagaaggtagtttccacatttaattttatcaagctacttagcatcgaatgtttaactcttcaaatttcttgcttgatgtgaaacaaacacaattaattttttatgtattatgaagtattttttgtattatgtattttatgtattatgaagtatttgtatttttgtttgccagagtttgaaacggcatcagatagatgaattggcttgtctaaagagaatctgtaatgttacaaaattgtaatacctctccaaatgttgaaggatctttgttaatcatgacttctactccaactatattgaaaattttggatcaacttttatggtgtacttttatgtcaaatgtattatttatttatttatttatttatttatttatttattaagatggagtctcactctgttgctcaggctggagtgcgatggacgtgatctcagcttgcggcaacctctgcctcccaaagcaattctccctgcctcagcctcccaagtagctgggattacaggcatgcaccaccaagcctggctaatttttttatttttagtagagatggggttttgccatgttggccaggctagttttgaacttctgacctcaggtcatccgcccactttggcctcccaaagtgctgggattatattacatattttaaagattagtatattttttcccagtgttttttaataatacattgtttcttataaaatttaatcttgataaaattttatacctctactgaaaggttgaaaactgccttttttagatgactttgaaagttttgttcatgttcctgtggttgggcttacctaactaaatttcactggtttttcagatatatgtgtatgtttgtacttctcttcgaaagtttgttgagtaggaatgaactcttttatttatattcaaagttttcattacattgatatatttttaaaatcttctttaaataaatttttagctacaactctgtgagttatgtattattacctctggtttactgatcagggaattgaattggtggaaggcactccaaaatcacccagctgtgtaagggatagagctgtaatttgaacccatgtctttgtgatgccagaatttgaatacggcattgcctatactttgaagggatgcctctgccaatgagtagttcaccccaaacaatgagatgggaaagacatttgctagccttcaggaagctggacagaatggaatgataaagtgacaaattgttaacaagtaacatatggaagaatcatagatgtcttgttaagtattcaataaattgttgaatactgattatagatgcaaacatatgcagaccacaatttaaaatttcacattttaatgagctacaaaattagtaatttgttatatacaaaaactagtactctcacaagaattgtgaagtgagtttgtttatttagactatttaatgtgaatgaaaagatgtcctctaaaagttcaaaaatacatgcagaatacagaaacaaaaacccaaaagtttaaatctgttgtttaaaaaatataattagtgttgtattttaacagaatgacttttctatttctgtagtatcctgagacttcccaaaatgttattacagtctcgggaagtaattttgttaaaatacaggactaattattttttaaataacaactatatacattttcccccctttttggggttttaaaaaaggttattaacttctcacagattttttttcctagcttttaaagtgaaattttgtacctatgataggattttcattatcttcaggagttcaagaaataggtggaagataaatcgcatatcttcatacactctctcttcattgactttccttcagcttagtagcattctccggtctcttttgcaaagcacagattatacaccagcagcttcttttgatctgacttaaccttctaactagcctcttgtctctctttttcattttaaagtccatgcctctagaataatccatatttgttttctatgttttctaaattaccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaatagaagggaaagcacagattatacaccagggagtctggctatagataacgtgctttaactactaagctgtaactccttttatattaaaacttagcttatatctctttctgttaacctgatttttcctaagtcttctcttcttcctgtgtttcctattttcggttatagaggtatcatcttctacccaatctttaattttcctcaacacttctttcttttttgtcccctgcattcatcatcaagtcttattacaaagtatagtattgactgtgaatctaacccattctacttccactgcctttatcttctcccaccaatattatttcaacaatttcctaattagtacccatactgacatgttttctctccagacaataccctacactattgtcagttatctgtaaaaaatgagtccaattctaatacattatcattcttaaaaatctatgctcatgacccattgctaactttttcattgtggtcctaacttaatattctggcctttgagcctgtcattctcccaaatgtaccatatgtttgcgccatactacatttggtgtttcccagatatgctgtagacttttaaatgctctcaaacattttatcatgcggaacactttgcctgaaatacctgtatttccccacctatatctgtttcttctgtgtcttgcataagtctgggaaggcttcagtaatgaggtgatattttaactaggcctcgaaggacaagtaagcatttttcataaattatctttgctgatagagaagcagtactatggtaggatgagaggtgaaaagggcttccaggaggtaaaatagaggccagaatagtctggcagtcacttcataaaaaacagtgaggtaataccagcatccagttgaaactgctttctagatagccaggtaggaaaacctaaggtatactgagcatgaataatggtttatagaacgggaaagtagtatagttaaaatacaatgatgtactatcaaaacagccccagtcttcacaggctgctgttagtttgaaaggtgccatgtttttacaatatttcaatatatacaaagaagtggagtagcataatttaatacatttaaaaactgttttctaagatgctgaaaataataatgaactctgcacattttgtaattagatatggtacacaaaaacagagctgtaaatatgccctttcctgatgtgtgatagcttcacttacccagtcctcgcctatttaatagatttgtcctttggaatacaactgagaactaaaaaataaaacaaaaattaaataaaacaatctgagcagcctacaaatgtcaccagatctatcaagtaagcctcatggtgagaacgactttttggcctttaatgagagcctatttattctcttttcatatgttatctttacgaacccaattatctgttttacatccacagcagactagaagtgcaggttggaaggttgggagagagtttattccagaatcgtacactggaatcatcaagaagtgacaactgataagctggcagcaggggaggggtagatagaaatgtaataaaagactgaaactggaatgcaaatgataacaatagacttcacagagcgcagaggctagtagccctgcacacttcagtacctcccgagatactgagttacaccatacctcactaactcacatatttagtgatgaccctgactcaacaggaaattgttaaattatatctagtttattttgcgtaagaatgtgggaattatataattcatttcagagagtgtcccatgtgaaacaagatgttgatacttaaatagataaacagatatatggaactatcctatgtggcttgattctttccacagtggttcttgagtgttgagattttactgcaagcatacttgtaaattagccattaatgtactcagaccatcacatatgagggagtagctttggacaaagtattaatcatttgtcagtgaaagtgcatttataagaaaacaaggcatcgaggcttatgaatatggagaaaatttgtggaaattagcatttataaagtgttgaatgactgcttgatattacttaggaaacttgttctatttattgacagttttatattattgtcatttagaaaatagattactataatgggaggttgtttagagatatttgtacaatgtagtcatttttggtattgacacaaaactaacttctgacttaaagaaggatgcctttattttaaatctgtttcaacactgaataattgtcaaacctatcattttcagtaatagagggttgccagtgacctccatgatataaaaaggaacaggctgcttttgaagtcattatattagcttcctcagcactatttggcactattgatcactcctttatcaaagctccctcctcccttgacttccatgatactaaactgtattagtccattctcacattgctataaagagctacctaaggctgggtaatttataaagaaaagaggtttaattgactcacagttccacaggctgtacaggaagcatgactggggaggcctcaggaaacgtacaattgtagtgggaggcgaaggggaagcaggaggaagagagagaaggggaaggtgctgcacacttgtaaacaaccagatcttatgagaactcactgagtatcacaagaatagcaagggggaagaccgcccccatgatccagtcacctcccatcatgcccctcctccaacactgaggattacagtttgacatgagatttgagtggggatacaaatccaaaccatatcataagctctccttgtttttccttcacctatgtttcatttaaattctcttatttctatgcttgacccttaaatttgcagattcctagagcttgatcctcagtcctttggtactttgcttttctcatattgatgatccttgggcaatcgcatctatcctcacagcttcaattaactaccactcatatgtgatgtctttatctgatctcttctcttcctcccaactcacagaccccatatgttcagctgcctcctgactagatttcaaattcaatattgtccttaaatatacttatcttccttttaaaaaaaatccttctccctactctaatcctctctccagccttgacctgcatttctcttgtattcccaatcctggttgaccttagtattacctaccaattagcatatagcagaaacatactagtcatcttagaatctacccttactccatcttccattccattagtcaccagatcctatcaattctatatccttaatgttatatttcccttcctcgacatggtatccttctctctccaccctcactgccatttttaatttcagagcattgttacatctcactgttttatcctttccctatgttctattcttcattatggccccgtttaaattatcttccccaatgttgtctttctgaaatgcttttctcagaaatgcacttcagaatgcttaaagtccagcattggcttcccatagttcactgcttaaagtccaacaatggcttcccacagtctccagaattgcagtctagtcctagcccaaacaaaatacttcatctggctgttgctttctctttcgcctcatattccaccacccttctacatatgtttttagtctagtcatattgtgctttgtttcctatagattttatgctgttttatacctctaccttcatacctttgtacatgacttccgttggcttggaaagtactccacttctcaattaactcgctctgtacattcacatctttcttctctcatactttgacttaaatcatctttgttcctaactcctgctgggctaggataaagaaagaccttgttaatgtcaacagagtacttaataaggtcaagtgtggaacagtgtcaataaaattttaaatgtacaatttgtcacagataatggcaatatggataatctgtctgagaatgccctggagttgtcaattattgtaccccatagctctgtgaattgtgattaaatagatagatgtttgtatagttttcaagcctgtaagttaaagtcagtaaaaggttctagcatttttccagtaattttatgaagatatttgtgttcaaatatttccctttctctgtcacttaggtaaacaacaacaacaaaaaaacttaaatttctttttgtaatgctatgtcttatgccaataaaattggaaatttttaaatgtcattcacttactatattttaattattttatttgggacagttaagtgttacaaataaaccctaggcatatacagatgagctttgccttttgaaagtttatcatctgttttataatatttcaccctttataccataccaccccagaatgaagacaacagcatctggtgactaaagaatgtagatgattattgtagaaataaaataaattgttatagtaaaggaaggatcttaatgtggtagaaaactgataatgattcagtgtagtatataattatacatgacataaatgattggatactttatcacatgcacagaactggtagtttttaactatgtatgcttatgtattcatttaataggatatatatgcatctcatgttgaaatcttatgacatcactgaatgaaaatgcaaatatagaaaccaattgtatttactaattaaacatcagaattgtggccctagcatatgtattaataatggagaaaattcactgattttttgtgactttaaaattttgatcctcatggaagctgtatttgtaacaatagatatggcggaccattttgaaacatagccattataaagacactaagcaacagagcaactctggataatggactttgtgatattcaattcaagggcatttgttttctttctaagatcaggagaaatgatatcaagcaagatttgtgcgatataatgtggtagaaaaaatgcaaggctaaaggtcaagagagctgagttctagttgtatcattggggcttattagttatgtgatcttgggcaaatcatccaatctttctaggttttcagtttctttacttttaaatagcatattggaccagagtattttatgttctgtctagctttaaaatctcatgattattttctgtctctggagttgaattttttttttttttttttttggaaagcagattgattttgcattgttagaggacaatagagtacactcatctcttaaagatttatatacttggaagttgagcatatgaattttgaaattttcattattcagcaatgagttttgtagttctttgaagtgaaggtttcagagattaggccagatctctttttttctttaaaatctccagtgtagtgctattcaatcaaactttctcccatgttctatatccctgctatccaatgtggtagctactagccacatgtggctgttgaacactggaacaatggctagtgaaactgagcaactgaatttttaattttatttaattgtaattaaattaaactgtgataagtagctcccatatagaatagcacagtactgtagagcgtgtgtgtgcgtgtatgcatgtgttcacatgcatatacatgctgagtgtggagtggggtggcagaagtaaaggagaggagtggtagaccattattttggatgatgggatgccatttatactttactgctcaggatgtacatgaagtggaatttaacccactccaagaaccattttctacttttgctttttttctgcattacattatatattatgatagtcactatgtgtactagacaacatattgtttatattattgtatgtttttctaattaacctatagttttaaagctacatatccccagtatattaagcatgttgcaccagttaaattttatcatcttacccatccttaaaatcttttgttgcgagaatctataaatggagtttatgagacctttggaatgtgctggaaattatatttgtagtaaaattatatcatttatagtcatgagtttcctccttgctgtgtggccttatataaagttattctatctgctttgagcctccacttcatcatctgtaaaataaggataacagtaatactaatcttgtgtggtttttatgaagatgagattagatggtgaattatgtaaaggacctaatacattgtctaataactaataataataatggtgataatagtttgggatttcgtatttagctatgaattcaggatacacagaatgggtttgtcatgtttataattaagtagtaatatattcttccctttaagctaatttaaatttaattttgtatttgtaaatagtgacaattatttcagttttgaatttgagatatcgtttctattctctgaaaagggcagcacttgtgtaacggcataaaggaatagcaaaaatttagatgacctttttgttttccacattcatattacaatatacatatttctgtaaaagaatattattttatcagcttatgttggaaaatgacatgatagcatgtttattcatctgttatttgtaattaattaaatatctattagaatatgatatataataaatggtacattgttaagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgtgtgtgtgtgtgtatatgtgtgtgtgtgtatatacacacacacacacatatacacacacacacacacacagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctccagaggtcaggagttcaagatcagcctggccaacatggtgaaacccatctctactaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggagaatggtgtgaaaccaggaggcagaacttgcagtgagccgagatcccgccactgcactccagcctgggtgacagagcgagactccgtctgaaaaaaagaaaaaaaaaaaaaaagaagttgaagatgatgtcttaacatagtgggtgctcagtagatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctctcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccaatttactgtattgttgttctcacacaactatgaagaaatacctgagactgggtaactttttttttattttattatttctttgagacggagtctcgctctgtcaccaaggctggagtgcagtggcgtgagctcagctcactgcaacctctgcctcctgggttaaaacgattctcctgcctcagcctctcgagtagccgggattacaggcacgtgtcaccatccccagctaatttttgtatttttagtagagacagggtttcgccatgttggccaggctggtcttgaactcctgacctcaggtaattcacctgcctcggtctcccaaagtgttaggattacaggcgtgagccaccgcacctggctgagactaggtaatttataaaggaaagaggtttaatttactcagttctgcagggttggggaggcctcaggaaacttccaatcatggccaaaggggaagcaaaacacatccttcttcacatcgcagtagcaaggagaagggccaagcaaaaagggaaaatccccgtataaaaccttcaggtcttgtgagagcttgctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacacatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacacacaaatgagttacagttatatatacttagtttcattgcactaagacaagtacaataaggtatgagtactaacccataattatttagtcacatagtaatgaaacaggaaattttcccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttacggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcactgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacaattatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctcagttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgcagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtccaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagcgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagatttttcgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttcttttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccactgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagcaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaagagggatttgctagttagagaagatagtaaagggtatttccagcagagggatttatatatgcatgtaaggcactgttagagaatgatgttacaaagttgagtaagatggttcctgtttggaaggaacccttcttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccaccgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaacttcattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgtcatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagatggtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcatttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggcgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggctttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttctttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatc

SEQ ID NO: 885 - DNA, 379214 bp, mus musculus; identical to SEQ ID NO: 884

SEQ ID NO: 886 - DNA, 1391 bp, mus musculus
cagggggagggccgaaaggaggggcctgaaaggggcgggccctgacgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgca

SEQ ID NO: 887 - DNA, 138115 bp, mus musculus
cgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaaatattagcatgtgcgagtttggtagtgatcaggtcttcagattcttgtgacgtgaggcttagggttggataaatggctgatttttcattcattgtgaaataagttaaagagttatacagcaggtgtgtagatggcttcttaaattatttgtgtggatttctgtagcgactagaacttacacgagaatttgcaaaatttctagtagaacctgcttaaattaagcatgttattttttggaagttccatagttacaacgttaattgaatttacacggtgcagtttacaggtgtatataattgcttcagattgtcttttagtttaaataagcaagttgtaggtatagattaaatattcatgctttatttttcggggagagaagtatgtgtactgttcttttacctggaaacccatgagtccctaaatctacttaacgtttgtatactttcacttttgaggaagaatgatttggggtgcattgattaggaaactttccagcaggtacttaaccctctcggagctgattacccttaggtaaggactccttaaccatgactagcttggctggttagtacacttgaactcaaaaatagagactataaactctcctttagatctcgctcgtcttctaattcgctgggctgccattttggtttcagcaaataccttcaaattcttgaagaattatgtattaaatataaaaaagtgtcaacattcgttttctcaatttttaaactcatgtgctgtgtcatacatctaactttaaccctttaaactttatcgttccagcttttgggtggagtgaaagcttgaagtatttggaattggtgttccacaggtgaactcaaaatgtctttggtattttactgttttattttctctaatttaaaaataggacgtttggactatatgaattctctctaccccttttcttgtatttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattttccatttattgccttacgatgggtctgaggtctgtcaggttcaaccagtggtgcttcgactactgtgctatgttagtgaaatgacactgattgctatttttaaaaaagcatttagagcttttggtttgtttctcgtaccagagtaagttaagatatagtttagtttttaagactatcaagatagtctccaatttgataaatatcttggttgcccaagggagatgttaaaagctatgtggcaaataggtttctccccttccatatatcttccagcgtgctcagggtgatagtttagttggtgcgtttatgacaaaatattacacaacattcctaaaaggtgtagaaactatgcatttgtctcctagtaatttatttaaatgatcccacaaattaccgtttagtgtcacatgaaattctgttatctcagtttgagaatttagagttttatttgtcttagtcaaaatcagtttgattttgattaagcgttttgaattttgtgttgttttgggattgatgtataattgttttatggaacgaatgaaataacaataacagacatttatttggagtttctgtctcttaatccccttggtccattggaccaaattctgcatggtgggggcatggcagcagggaagcctataggagtttaggatctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttctgatgctgttaatttttgaccagaaattacatactctggtgtcaccccttactcctgccattcctttgctgtattgatgctctattatctctatacagtgtgtttttctatttaatttactttgtttaggtgttttgattaattttgtcctcacaattctatctttaaggttagtggctttcattctaagtcagtgataatatccttagcacctagaaagtgcctggcatatagacatttagtaactgttggatgaatatagtttatcacattcttgctattttacttattttttgctaaatctttttacttctgggagtcacttttcttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaacttgcagtacctccaacctcttgtacagaattgattcatcttcattttatggcaccctacagtttattcttattaatcatgtgagctttgaacaccatgttagtcaaccataatcaaaggaattgttttccttgggatgagtttgagctggtgatcgtgcatattagatcccatcttctacagagcctgtgaattgggtggaaaggaaaaagggagtggcgaagcctcctgttagtatccttgatgtccattttattcctgctgactttggtggctattgagagttataagttgaggctgttggttacatctctcatttctagtcttttctgttaactggttacttagaactcctaagtaaggccgctcattattaacttggaccccagagagcatggaagttaccgtatagtattgaacccatttctgcctaacagtgttttctctctggtcgaggtgtagtgtacaaagttttggttgctctgcttggtaacatctctggagttcagagcacagggatcagtaaactttttctgtaaagggccacatagtaaatactttggactttgtgggctaagaggcaaaattgaggacattgggtaaaatttttattggtgaaataaaaaatataattaaatacagttatgtataacttaggtctaatgagaaaaacaatttggtgtgtgtgtgtggaggggaggtaatacagtattttgctttattgggtaaagttcagtgttccctgtcatcaaattgattgcagacgttctgtgtgaaatccattcttaccttgtgagctgtacaaaaacaggaggctggaattggtctgttaccatagtttgccagcccctagttaagagcagtgatttttttttttaagaggaggggtctcgctgtcactcaggctggattgtggtgacgcaatcatagctcattgtagcctggaattcctgggttcaaggcatcctcgcacctcagcctgccgagtaagtaggaccacaggccgacatcacctcacctggttaatttttgttagagaacaggggtttgactgtgtttcccaggctggtctcaaactcctggcctcaagcaatcctcctgttttggcctcccagtgttgctgggattataggcctgagccactgtgcttgacctcctatttgatacactatatgttaacaactctgaacctcctttccttaagtcaggttcaaacttctgtacattagctgatgaaagggatttctttttattgcaaggtggtattgcctgagaatagtttggtttcagcagctttgctgtatttgtacggcagtatcttgtgtttatgtgcaagttcagatgtattttgcctttttataagaatgagcagaaaacaaaaaagtaaatggcgcgatctcggctcaccacaacctccgcctcctgggttcaagtgattctcctgcctcggcctcctgagtagctgggattacaggcatgcgccaccacacccagctaattttgtatttttaatagagttggggtttctccatgttggtcaggctgtcttgaactcccgacctcaggtgatccgcctgcctcggcttcccaaagtgctgggattacaggcatgagccatcatgcctggcctacctggaggtcttaaatatccttgagacagagggaactggttagggatatgaatcttaaaccttactggattaggttgtgctcattggttaggttagttggctttgtgcaaatagtgaatgcaataattagaatgaaataggaattaagtgaggcaaatgtatgatgaagtttacatttgaaaggtgagggtataattagaaataaaagtttctgtactctgtgagtgggaaaaacccctaaaaaggtgactgtcgtttttgaaatttttgacttctctcacattttcgggaatgtgaaaggaggatactggctatgtacagcatttgtccagacttttgaaaatatagaaaatctcatttactcatttaattagtgtgtatattatctgtttactgtgtcctttgtagatataattaattatccaggattcttaagagttgacttggagcatgctgagctgaggcaagagggattgtggggccagactgagtgttggaggaggaacctactgtagtgactacaggtgtatttcttttttctttttttttgaaatggagtttcactcttgttgcccaggctacagtacaatggcgtgatctcggctcactgcaacctccgcctcctgggttcaagtgattctccagcctcaacctcctgagtagctgggattacaggtgggtgccactatacccggctaattttgtatttttagtagagatggggtttcaccatgttggccaggctggtctcgaactcctgacctcaggtgatccacctgcctcatcctcccagagtgctgggattacaggtgtgagccaccgtgcctggtgtgtttcttgtctgatgtcagtgcatgtcgttatctgagccatatcaatgtcagctgaggattgctttgttatcctcggtgcattatgggaaggagaatcatgtcagtgctaccttactgtgattgaattgaattcattgatttaatatagattcagttagtacgccttatccataatatttgggatcagaagtgtttccgattttgtaattttttccccatattttggaatatttggaatattacttgcgggtgagtgaaaattcaaaatccgaaatttggggccaggcgcggtggctcacccctgtaatcccagcactttgggaggctgaggcgggcagatcacttgaggtcaggagttcgagaccagcctggccaacatggtgagacccccgtctctactaaaaatatgaaaattagccaggcatggtggtgtgcacctgtaatcccagctactcaggaggctgaggctggagaatcccttgaacccaggaggtggaggttgcagtgagcccagatcgcggtactgcactccgtctagcctgggtgacagagcgagactccgtctcaaaaaaaaaaaaaaaagttcagattttggagcattttggattccagatttttcagataagggatgctcaacctgtgccattttaggcaccagagggtatataaagatgattctctgctttcaaggctctgaagtatggtgaaccagacagttatacagtgcaattacagctgtattaagtggaggtgtgaaaagtgtagtaggagagatggagaaatcattgtttggcattgggtgaggtcttcaaagatgtcctattttcatggccctattaattagagcagggacttccggtcagagggatcaacttgagatcaggcagggttttttaaccctattgacagtttggggcagataagtctttgttgtgaggtgctgtcctactcagccctggcttctacccacaagatgccagtggtatagcccctaccccactcatatgtcttcagacattgccagttgtgccctgggggcaaaattgagaaccattatttgaaatggagcaatgcaagtgtgaaagtatagtgttttcagagtaagaactagtaggagagtgtgcaaggaacactagagatactgggaggggaggggttatgggagatggaactgaaaggtagtttgagtgaagctaaaatcacaaggggtaaccttgagtgccatgttaggacatttgccttttactgttaaggtaatgagagatgtactttgaagtttaagtgaaaggagacattagatttgtgtttgtttttgaaagataattctgatggcattcgtggcagatgtgttggagagttgagtgtcgggggattgagatggtattttaaccgttcttctgaaagataagaaataatgattagggaatggaataaaggaaggagatcaatggggtgctcccatggtatgagggaggtgctgctaatttgagtttggcttttctgccacagaatggagtactgagctaaaaagcaaaacacctctattgtcttcctttcaacttttcctgccacctccaattccctttcctcactgagagctgctgtctgttgaggtctgttgaaaggtcattgagagaagggaatctgggttacagaatgactactctctcaatgtggttccttaaacagtggattatcaaagcacaagtgtcatcttcccccccgctccccgcaaggggttagactggcatccagagagcattaattgtagcctctccttggtttgtgtagatgttattttgccctaaaatactttgatatacaaacataggtgaataatctgatggtttaattgtaattatttcattgcttcctattttggaggttagctttactattttaagtgagaatgtagtcagtggaagggtactggacttggagtcacaagatctgtgttttatttttttattttattgattttttgagacagagtctcgctctgccgcccaggctggagtgtagtggtgtgatctcagctcagtgcaacgtctgcctcctgggtttaagtgattctgctgcctctgcctctcaagtagcttaggattacaggcaccaccacccacggcgaatttttgtattttttgtagagatgggattttactatgttggccaggctggtctcaaactcctgacctcagctgatcagcctgccttggtcccccaaagtggtggaattacaggcatgagccaccgcgcctggtcaagagctgtgctttagttccagttacccaactccctgtgttaaatcacttagctaacctcttgggtcttcatgactctgtaaaaccaagatgttgggcaagaggtgagttaaactactacttttttaagttcttaaattttatctttattcctaaagatgtggaaaaatctgtagtcaagagaaattgtcaagtaaaggaaaacagagaaggtaaacactttaatgggtttagaagttggttatattcctccatttacttgtcaatccaacaacttgaatgtctcctctcccttgtttctcctgtgtggtctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaatgaaaacagacatttaataaagttatgtatgcttttaaaagtaacaaaaccccactgcatgtcaattagatatttttatgaaaaataacttttccagaacaaaaattagaagagaggcattgttttacatgttttacaaatctcctatctggcttaatagaagacaactggattctctgcctccttctgccttcaatctattgcgatataatacgtcatatagcctttggaagaactccatagtacacttgagaaagaatgacagtgaaaatggcaagtaaagtcttaagaaaacaattttgacctctctgacctcttgaaaagatctcagggatctttgagaaccagtgtcttagactgccaagagaagatgtgatgttatcttttgagtggcttatctactgtaaattttattttaactgagatatataacttacagtaaaatgcacaaatatgagattgtatagcttgataaatttttagaaaatatatacatctgtgtagtcattcagatcaagatacagaatatttccagcaccctggaaggttcccttatgcctctacctcctccctgtaaaaccccaaataccctgacctcttttttttttttttttcttgagatggagtctcgctctgttgcccaggctggagtgcagtggtgtgatcttggctcactgcagcctccatctcctgggttcaagcgattctcctgcctcagcctcccgagtagctggaattacaggcacacaccaccacacctggctaattttgtatttttagtagagatggagtttggccatgttggccaggctggtctcgaactgctgacctcaagtgatctgtccacctcggcctcccaaagtgcagggattacaggcgtgagccaccgtgcccagcctgacctctgtcttttaatgaatgttatgcctatttttgaacttcggataaatggagtaatacactatatactcctgtatctggctgctgttgctcaatacatgatcactaactgtctttttctttattgtttttttgagatggagtcttgctctgttgcccaggctggagtgcagtggcgagcttggctaactgcaacgtccgcctcccaggttcaagtgattctcttgtttcagcctcccgagtagctgggattacaggcgcctgccaccacacccggctaatttttgtgtttttagtagagatggggtttcgccacattggccaggctggtctcgaactgctgactgcctgcctcagcctcccaaagtgctgggattacaggtgtgagccaccgtgcccagccaacttcgtctttttcattactgtatagtattgtattaaatccatgatttatttatccattctgttggattgaggtgggtttttttcatttgtttgttttgaaacagggtcttgctctatcactcaggctggagtgcagtggtgtgatcacagctcagtgcagccttgtccttccaggctctagcgattcctcccacctctgcctcttgagtagctgggaccacgaccacatgccataatgcccagataattgttttttttttttttttttttttttttaaacagagatggagtctcactatgttgctcaggctggtctcgagctcctgggctccagcaatcctcctgcctcagcctcccagagtgctgggattacaggtgtgagccactgtgtctggctgacgtttgagattgttcagtgttttcaccaatataaagaatgttgccatgaacacttttgtatatgtcttttggtggtcttttgctgcatatccaggattggaattgctggtttataggatacatatgtgtttagctttagtcaatactgccaaacagatttcccaagtagttgtaccagtttaaactcctactagcagtaggtcgtgttgctcttccttatcaatacttagtattattatcagtcagtgtttctaattttagccctcttggtggaagtttaggaatatctggtggcttaaatttgtatttgtgtctagtgtttagaatactttcacatgctcaccagtcattttactatttaactcttgcttacctataaaatttgaagcttggctaataacatcttgtgtagttcaaaatcactagttgaatgaattttctgaaatgaggcttttaaaaataaacttaattggctggtcatggtggctcacacctgtaatcccagcactttgggaggccaaggcaggtggatcacgaggtcaggagatcgagaccatcctgaccaacataatgaaaccctgttgctactaaaaatacaaaaattagctaggcttggtggcatatgcttgtaatcccttttctgagaagtctttaatagatactctctaccctcttctaatttactccctttccaagctttttattaaggaaaaatcaaacatacacagatgtagataaacttccatttgcccatcaatcagcttcaactcatggctagtcttttttacctacccccttccattttgatgcaaaacccagacagcatttcatcttacatatttcagtatatcccattctaatttagatgtttttttccttggtgctcatattgtgctgctctattgtaaattataagttcaatttagttcttacatattctctcattctgctttgtaaacttctcacaggtaacaatcactaacacttaacacctgtgtgtgaggatctatgaaattgcttcacctgcataaattctttatattcttacaacagctctaaaaggtagatattactgtctctgttgtatatataaggaaaccaaggcacagaggttgaataacttgtccagcttgtacacctagttaagtggtagaacaggaattcaaactaaggcagtttatcttcagtctttagtgttaactactgcattacataatgtctgagtaaatgagcgctctactgcatataagttccttcaatcgtcctttttaattagcattttttccttgttaattttgcctcctgtcttgcatttccaacggcacacaagtattatttgctctttcataaaatctagctaaaagggcccttagcatgcaactctcttattttttatttatttaaaaaaaattttttttgaaatggagttttgctcttgtcacctgagctggagtgcaatggcgtgatctcagctcactgcaacctctgcctcctgggttcaagcaattctcctacctcagcctcctcagtagctgggattactggtgcccaccaccacgcccagctaatttttgtatttttagtagagatggggtttcaccatgttggccaggcaggtctcgaactcctgacctcaggtgatccacccgcctcagcctcccaaagtgctgggattgcagatgtggccacctctcctgttttaaagatgatcatcccttgcttttagctgttctgcttctaattttatatgtgatattctatcaaaaaattgctgacctctggtctttttgtttaataatagtgtctctataattatggggagaaggtaccacatactgaatttaaatattttcgtcttttatatactatattttaaatttttaatgtttttatttttgctttaacattgtatttgaaaatttcatttgcagtaactcgatacagctttcactttagatttttctgttttgagtattagcccttccggtgttaatttgagtgttcgaatctttaggattaattgtgcaaagatataaagactttagagaagccagccaggcacggtggctcacacctgtaatttcagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactattacagaaacaacccaaatgtccattgtccatcaagtgatgaatgcataaataaaatatacaatggaatattatctgtcaatgaaaagaaatgaagtactgatacatgctacaacttggatgaactttgaaaatgttatgcttaagtgaaataaaccagtcacaaaagacctcatatcacatgatgccatttatatgaaaatagattagcatgggactgaggggaggttggagggaagggagaatgctattaatggtatgaagtttctttttgggggtgatgaaaaagtaatctgagatcgattttggtgataattgtgcaactctgaatatactgagaacctttgacttgtacactttaaatggacgatttgtatggtatgtgaattagatctcaagggtgttattttaaaaaacttaaatataatttataatgataatctcattgattaaacataatttgaaattttttggtgtactttttcagattctttacatttatgatttaaccaatctggttttggaagatacaggcagaaagaacacccagtggaggcacataaaaaatgttactagactgggtgcagtggctcatgcctgtaatcccagcactttgggaggtggaggtgggcggatcacttgaggtcaggagttcaagaccagcctggccaacatagggaaaacctgtctctactaaaaatacaaaaaattaattagctgagtgtggtggcacacacctgtaatcccagcaacttgagagggtgaggcacgagaattgcttgagcccaggaggtggaggttgcagtgagttgagatcacgccgctggactcaagtctgggcgacagaacgagactgtctcaaaaaaaagaaaaagttaattattaatactgccttgtctaaaatgtcataaatgaaatgagatctttcttttcagtgtattgggttagcatttcatgattgggttagtaacttagaaaagttagataattttgtcaaaaattggtaaaaagctgttaacagataactttgagtttatcttttttttttttgagacggagtcttgctctctcacccaggctggagtgcagtggtgcaatcttggctcactgcaacctccacctcctgggttcaaacaatctccctgcttcaacttccctagtagctgggattataggcgcccgccaccacgcccggctaattgttgtattttttagtagagacagggtttcgccatattggccaggctagtcttgaactcctgacctcaggtgatccgcctgccttggcctcccaaagtgctgggattacaggcttgagccaccacgcccggcctaactttgagtttatcttaacctgttgtttcaacagagtagattgatagttaggcatacccgcattctgtaacatttgatgtgacttatgtctaatattaagtcaacattgctcacctattggctgatttagggactgggatttgtcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaattttcttcagagccagcacaaaatctgataggaatattatgctatgaattgtcttctagaaggtaagataccacccccactcccccttttttgagacaggttctcgctctgtcacccaggctgaagtgcagtggcgtgatcatggctcactatagccttgaactcccaggcttaagccatcctcctgtctcagcactcccagtagttgggactacaggtgcatgctaccacgctgagctaatttttgtattttttgtagagaaggattttgccatattgcccaggctggtgtgctgggcaattcctgggctcaagtgatctgcccacctcggcctcccaaagtgttgggattacaggtgtgagccacttcacacggcctatacctttaacttgaaatttactttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaaaaaagatacctggagttagaacatcatctgttgtcggcctgtctgctatgttgcagtatatgcattgttgaaaacctcatagtctgcaaaaatcaggtaccaaaaactaacaatgtgtatagggaaaaatgggcttaagagtaaactgatcacttcaaagctatgttactttgtaattagagcactaacaaaacaataaaaattccagtaaaatagcacagttttgaagatcctaaatttctgacaaactacaataaatataggacttgaaaaaggtagcttgatggaaggggcaggtataagggggagggttggggtgactgacttagagagacaaagctaagatgcataaatatcaggtggaactgcgtacatacttctgagacagagcatgtggcctgactaagccaagaagaataatgtggggctaggaggtggtggtgatgagcatctggttcagacctataacccccaaccccatgctgcattcagcttctgttacttgtgggtacaaaacatcaatgtgttgggggaaaagtggcaaccactattctactttgtgaatttgacgactccaggtacctcataagtggaatcataaaatatttgtccttttgtgaccgctttatttcagttaacatagtgccctcaaggttcatccatattgtagcatgtcaaaatttccttgctttctaaagctggattattttccattgtttgtatgtatattttattgacacattcatctgtcaaacggatacatatgcttccacattttggctattgtgactaatgccgctatgaacatgggtgtacaagtatttgttcaagtccctttcagttcttttgagtgtatacccagaagtggaattgctgtatgtatcatatgtaaattctgtgtttaactttttgaggaatcaccatatgttttccacagtggctgcaccattttacatttcttccagcaatgcacaggggttccagtttctccccttatccttgctatcacttgtgttttctgcctttttgattatagccatcctagtgatatctcatagtggttttggtttgcatttccctgatggctaataatgttgagtatcttttcatatgcttattgaccatttgtatgtcttacacattcagatcctttgcccatttttcaattgagttgtctttttattattattgagttgtatgaattctttgtatattctagatacaagtcccttactggatacattatttgtaaatgtttttcttgtaatttgtgggctgtgggttgtcttctcactgtttacagtgttcttcggagcacagaaattttaaaattttgataaagtcccatttaactatttcttttgttgctcctgcttttggtattgtatctgttagaatccattgccaaatcctaggtcattaagatttaccctcatgtttcattctaagagttctatagtttttttatcttatatttaggtctttgatgcatttcatgttaattcatgttgttactgggaaacacttctatatgtagtaggctcaacaatgaattatacacatgttgtgttacacaatgcattttaagtcagttaagagaaagaaatatgcagtcatactgttttcttataattgcataattgtatttaccagtgttatttcactgagtttgtgtcttgtcatgctcctccggttgtcatactggaagtatatttctgaattaatttttttttttttttttttttttttttagacagagtcttgctctgtcactcaggctggagtgcaatggcgcgatcttggctcactgcaacctccacctcctgggttcaagcacttctcctgcctcaacctccaagtagctgagattacaggtgcctgccaccacgcccagctacttttttgtatttttagtagagatggggttttgccatgttggctaggctggtctcaaattcctgacctcaggtgatccaccagtctcggcctcccaaagtgctgggattacaggcgtgagccactgcacccggccctgaattcatttttgaaataaatttggttgatagttttctttctttcttttcttttctttttttttttttttttgagacagagtcttgttctgttgcccaggctggagtgcagtggtgtgatctcggctcactgcaacctctgccgcctgggttcaagtgattctcctgcctcagcctcccaagcagctgagattacaggcgcccgccaccatgcctggttaagttttgtatttttagtagagatgggtttcacaatgttggccaggctggtcttgaactcctgacctcgtgatccacccgccctggcctcccaaagtgctgggattacagacgtgagccactgcgcctggccaatttttgtatttttagtaaggatgaggtttcaccatgttgaccaggctggtctcgaacttctgacctcaggtgagccacctgccttggcctcccaaagtgctgggattacaggcgtgagccactgcgcttggcacgatagttttatttctttcagtgcttgaagaatgccatcccactgccttctggccttcaagttttctggtgagaaatcagctgttggtcttactgatgatcctttgtatgtggtgatggatgcactttttgctgcattcaagattgtctttgtatttggcttttgacagttgatgatgtttctcagtctggatcttgaatttatcctacttggaatttgtcgaacttcctgcgtgtgtagattaatggttttcattaaatttggaggcagtttttgattctgatttcttcaaatgtcttttctgttcccttttctcccgtttctggggctctcattatgcatatgttggtttgcttattttgtcacacatttctctgaggctctgttcattttttttctctgttattcagattgcttaatctaacagtctgtatctttgctgattctttgttccgacagctcattggctgaatttttcgtttcagttattgtacttttcaacaccagaatttccgtttggttctttttgttgttaaattctgttagtctctgtttgtttagaaattgtcatattttacttctttaagcatggtttcctttagttcattgaacataagcataagagctgtttttgaggtctctgctaagtctggaccttctcaaagtcagtttcttttgcctactttttttctgtatgtggggcacacattcttctgtgcatgtcttaaatttttttgtttaaaactggaccttttatataatatagcaactttggataccctacacctctagcagctttgttgtttgttgcttccttatttatgtagtgactggctgaactattttagtgcctacccctcagcctgtgatgttgctcttcagcgggtgtagccttagtcatgcctgggatgatggtgattttagcaaggctttgtgagtttctgtgatctctctgttaaacctctctctgtgttggtatcacatgcacatattagcctctactaattgcctactgattggtctgttgatttaaatgactccttgggacataaattgccccacagtctgatccagttaaattctcatgctttccaggggtaagtaatctttgaggctgtgtctgaggtttgttctgaccccaggaaggttcttagcttttatttccctggttctatctggtaagctgctagctgagtagtttaacttgttgctgtccaccacaggtcttttgatagctgcttattaccatgatctctcctgttttgtgttgttttccaacacaccctcaggcagcatattaccatattgtttcaaatagttcactttaagacaacttcagaactctgttcttacggcctgcctttccccctgggcaaaatctttacaccactgcttcagaactgggttggactgtggctcacttctcagagtgacacctctgcttcttgagcagggtgattggctttgcctgccatggaatcttgactctgagtgaggtggggtgggggccattaggaccacgcttttcttgacttgctgcacctggggttaagagcgtctgcctcacaagtggggcctagctggaaaaaagagccccagacttcttagccactcttggtgcaatagagcctgtgcaactcaaagttgggggtgttgagaaatgctgcctgcctttacctcctggggagataccatcaactgggagctgggtcgggggaggtgtgttcttggccgttctcacctggagtggagctactgtcctgctgagctggctcaaatgccacagactatccttactgagatatggtagattttcttaaataaattattttttcatttggtatatgcccttaggacaatttccagaggcttttagtgttttttgttttttaaaaaaataattttcaccagttaacgattgtttcactggggagagcatttacggagcctttgagggcaccattccaaaagttatttttaatgtaaaattactcaaattgcctacagccacttaaaaatttgtgtttgagaatgctttggaaaagatgctgaagtttatatgtatgtaaaagcttcattactctaattgtgtacgtacaacttgacagatgctcgatatggaggaggtttgaataagggtgtttggccaattactgagcatttctaaaagaatacatttctgctgccacaaagaattttgaatgcaggatgcagttctgttgcagtgacttataggaagtagccatggatgtacacagtaatttagtgacaaaaatcaggaatctgtaaggggtgtgtatgtgtgtgtgaatagtgttggaaataaaatacgagcatttagctcaagtaacatatttgaatttaacaaagattaattggacatctttatttgcattaacctgaattattgattggatttaaagctgtctagaagtagcatcacactggggatggggggggcaggaaacctgtgcttaatacagttatcttgactggctttgggtataatttatcataatgtgtgataagaatgataaagtctgtgcaaatgataatggcagtgctggtggaactaggaaaagaaaagcttttacctttgagcaaaggccacattttaaaataacttagggatgtttaggtgtatagctgtgggctcaactattaaaaataacttactgtatttcagactccttaacatgaacctcctcatttaacacactctgtcagagggagagatccccagacttctcagccactcctgcctgtttgagaaggattctcaaacaccccctcccccagagaaggggcctcattttgttgcccaggctggcctcaaactcctgggctcaagtgatcttcctgtctcagcctccggagtagctggggctataggtgtgcaccaccacagccagctaatttttataacatgattttttattccatatatctgaggaatacagctaattgtgtcttagttccttgatatgtactataacagtgacaacgatacttaacatgcagaaattgtgaattaagtgaaaaatccaattttgtaaaacatgtttctgcatcaaaaactaaacagtttgtcttgggagtggggttatggtgagattaatggtagtttccccctcccttttctgacattattgatgtatggtgtgatagttaaaactgtaggacactggcacttgtactgtctgagtttgaatcctggctcctaccactttgacagcctgtagtcctctgtcccagtttttttactcatgaaattgggctgataatagggttgttctaaggattaacttgcttagaatagtgcctgagacaaatacttaaatgttagctattgtcactattaatgaggaaaatgttatttaaaatttgaggtgtgtcaacctggctgcactagtattgaagttgggaaatgagagacaaagttggaaaaataagttaaaggctgattatgaatgaccttgaatatgtaccagatggagaagagaagccattcaaggttttagagattgaaagtgttgagattaatttagcattaatatactgaacgattggtatggtagtgtggacgctagccaggatgctgttaaaataggagtctaggctagagtggtttgagtgggagtggaaaagataacattggacacatcatgaaagaagaatggaggagatgggaagggagagatttgactttgtttttactgtatttccccacactcccaattttagttttgagcactgctatagactgaacgtttgtctccacccctccacctcgcaaattcatatgttgaaacctaaccctcatgtgatgaggtggggcctttgggaggtgattgggtcacgagagtggaaccttcacaaatgggattagtgcccttgtattaataaaagagactccagggagttccctcactctttctgccttgtgaagatacagtaagaagattgctatctgtaaaccagaacgcaggccttcaccagacgctaaatatgcttggcaccttgatcttagactccccagcctccagaactgttaagtgttacttgagccactcactctgagcttttgttacagaaggggctaagacaaacaaacacctgttgtttgccaatgaatccttgggattcagtgatgagcaaagcttgcatagcttctgcccttaaggagcttttatgttttagtaagaagataaactcacacaggtgctatgagaaaatagggtagctggctcctagagtctaggatgtgagtacttgatgaatcctgagtcaggagagttgggagctgctgaattaatatgggtaaaactaagcagactgctttgttcagaggctctcagaggtggcatgaaggagcactttgtgaaggaacaacaagaaggcaaattgaactggagtttgaacaagctttggctggggttagctgcaagatgaggctggaattgggtgtttgagggccttgtagaccattagataagtattttgatcttcatcctggtctttgaagattttttttttttttttttgagacggagtttcactcttgttgcccaggctggagtgcggtggcacaatcttggctcactgcaacctccacgtcccgggttcaagcagttctcctgcctcagcctccctagtagctgggactacaggcatgcaccaccatgcccggctaattttgtatttttagtagagatggggtttctccacgttggtcaggctggtctcgaactcccgacctcaggtgatctgcctgccttggcctcccaaagtgctgggattacaggcgtcagccactgcgcccagccagtctttgaagatttttaagcagtgctgtgacatattttgcatttcagtaaaactcatagtgatgatttttaataccgaaagaacaaaacaattgtaggaatggatgcaggcctgacagtcactgctttcaaaagaaagctcaatcccttttccctgttgtttccttttctccccgtttgaatttatagagaacaacagattctgtagagaaccttcatggtatagttggaagagccaagggttttagagtcttaacggaaattattgtgatcttgtataagctcagtgtacttaatctcttagcttctatttatgtctgttaaattggactgatggctgtatgagataggtattatgattaaatgagattatacaaataaagcacctactgttgtgcttgatacacaagtaagtacttaaaacttttcaagaataatatacaaactaagaactggaaaggagccacagagaacttttgaatggaatggaaccaacaagtccacaaaagaaaaaaaatctttagcataaatactgagacctgtttcgccttgcccacagggtggttatggaccatagtgtctaaatataattgattgtgaggtgtatgctacaagtaattataagcaattaaataattagttaaaatagtaatgtttgcaaatgagattacctaaaaatattagagtcaagattatccccttaataattattttcactcacatttcatgtgttttcgattgaggcaccaaaagaatccttgaagtccagcatataagctattaatgtttgctgtttttattttgtgctctgctttatacagtttttgttttttggcaatttctctgtgtccatagaagtgtgtcaaacctgtgataaccttattttagtgtcctttctcatgctgtggtagaaaaactgctgtgtaggttactttttcttctagacaacaatgcactaaaattttgtctttaaaaacataattgaatctgtcatagcaacagcatgttcaatttaaaaattcaaaaagatctaaacttggcttaaaaatacgtttttttgttgttgtttttatttgagatggagtctcgctctgtcgcccgggctggagtgtagtggtgcgatcttgctctctgcaagctctgcctcctgggttcacaccattctcctgcctcagcctcccgagtagctgggacttcaggcacctgccaccatgcccgactaattttttgtatttttagtagagacagggtttcaccgtgttagccaggatggtctccaactcccgatttgtgatctgcccgcctcggcctcccaaagtgctggggttacaggcatgagccaccgcgcctggccaaaaataagtatttttgtactctaaaatggtgggcattttgaaagaaagcttagctgaaaagatgctgcttactggattgtaataaacatgaaacaattgatttatacattcacattataattttaaatcagtatatagttgacccttgaacaacatgggttcaaactgtgtggtccactttcactgcagatttttttcaataaatatattggaaaatattttggagatttgtgacaatttgaaaaaaacaggataaactgcatagcttggaaatactgaaaaaattaagaaaggtgtgtcatgaacgcgtaaaatacatgtagataataatctatttactaccataaaatatacataaatctattataaatttaacatttatcaaaacttaatgcacacaaacgtttttatagaccacatgtggtgccacgtgcagttgagagaaatgtgaacaaatgtaaagatggattaagtcataactgcataaaattaactagtacattctctactactgtaatttcatagccatctccttttgctactgcgatgagtttgttgtaagtatccgatgaaaatatgtgacgctgatctctgcatgagcagttcatctctccagtaaatggtctatcatagtaaaaaatgatctctcatgttctcatgtatttttcatcatgtttagtgcaataccataaaccttgaataacattacgggactcatgaagtgtcactagtggtgctggcgaacaggctcccaagaagcagagaaaagtcatgacgttataatgttctgcaaagtttcttataagaaaaagttgaattgcttgataggtaccatagattgaggtctgaggtctgcagctgtggttgtccgccatttcagatgattgatcttgtaaacagatgatgtaattttactttattggtaaaaacagtacagtactataaatacattttctgattttcttctttccttttttttcccttttcttttttttttttttgagactatctcactctgtcacccaggctagagtgcagtggtgcgatcttagctcgctgcaacctccacctcccgagttcaagcgattctctgcctcagcctccctagtagctgggattaaaggtgcacaccatcacacctggctaattttttttgcattttttattagagacggggttttaccatgttggccaggccggtctcaaactcctgacttcaagtgatccgcccgcctcagcctcccaaagtgctgggattacaggtgtgtgagtcaccaccccttctgagtttctttttttctctagcttgctttattgtaagaatacagtattataatacatgtaacaaaatatgttagtcgcctctttatgatcagtaaggcttcttgtcatcagtatgctgttagtagttaagtttctgaggaatcaaaagttatttatgggccgggcgcagtggcttatgcctgtaatcccaacactttgagaggccgaggcgggtggatcacgaggtcaggagttttagaccagcctggccaacatagtgaaaacccatctctactaaaaatacaaaaattagcccggcattgtggcacctgcctgtagtcccagctgcttgggaggctaaggcaggagaatcacttgaaaccaggaggcagaggttgcagtgagccgagattgtgccactgcactctagcctgggcaacagagcaagactccgtctccaaaaaaaaaaaaaagaaaaagaaaaaaaaaaaaagtagtgaggtctggcgccctctactggtgaaggctaagtatagcttgtgttgtacagttaggtctcttgtctctagtgagtcaaatattttaatggaaaaacaagggttatagatgtcggttaaacatagaaatttgaaaggaagagaagtaattccctttgattgttggtgcataaaaccggaataggcaaaattcacaagtcaagattaatttccaagtcaagataatttccatgtttgagcttaaggatgatctatcaaattgttttctaagaaactcatttcactttgatgtccagtaaaggaaataatctggtagggggttggagttgctgttgcttgtttattgtctctatccccagtctgtaatgttccacaaaagcagagatatttgatgcactgtgtacttccatatattctcctatgattagaacaatatgtgacccattgcagatgctcagtacacaatttttgaatgactaagctttgagtttttatttaaacaccttttttttggatgaaaagaaaaattgagagaagaaaatcttaagtatcctaggatcatatgtagaatcagaggatttcaacgtgctgtataaaaggagagagattctggaacatagggcaaattttagcagagttgggataatgactgggtaagaaaggataattctttgttctaaaagggatttctctggtattaaggccctgtgtgaaagctgctggagaaattcagttctgcaaagtttaaagtaaatggtttgctgtttatggagtactagattacttaatgcagtccagcctttatctaggtaaaggtgatgcttttcccattgtggaagatgttaggatgctaagtttgaatatgaaaatgtgttgtgtgttgtagaggcaatcaaatcaccattttggttgtatttcccattgagaaaattaaagatgcttctgtttgtgtaataattttgtttttatgaaataaagcgtaaaacttcatgtggtaaaatttcacactgtgattcattgtatttgagcatgcctatggaaagtgattgttactgtgtcaaatattgaatgatttgaataattactaagttgttcagttgtgtgtaggatactgctgctttgacttggtagagagcttgttctagccctgctaggtatgcctaaatctctgtgacataaaaaacaggctcttttagagttgtgagactgctacttgaaatcaggcaaagctgtgtgattcccagctgtttccaccacttgagtattgaataggatttattaagaaaagtagtggtgttattcttggataacttagttgtatctgtgataagtttttttctcccactcaaacctttccaaattatatctgaaggcaatattttcagattcattcctgaaatatttaggaactctgcacagtacattgtagaaagggaaaagaaaatttacatttttttgagaattactgtgcttgctatttgtgagactccttttattaaagcaattctcatggctttcttttttttgtgtgggtaatagcatctcaattttaaatacctggaaaaagaatgagagaggttgttactttctttttaagataggcagattgtaagtgacagaagttggattttgaatgagttatgtttgaatccagaaattatttttaattgctccatgcctatttcctgctctttatcttgcatcttagtgtgctgagggaaagggatcaaattcttatgtggtagtagagagatgcagcagagtatgctatgctgagacctgacatacctgctcagcaataccggaaatatagaaatgaggacagcttgtcgggtagaagaaacagaaaccaagagctagaaaggcgagactatataagagatagggatagcaagcagcttgaggcttttgctgattgagtgtcctgtcataagcagaagatgatttagttctgtggtcttagagaaaggtgttttgagagaggagtttcacactgccgcttttcccatttatcttagttattttgtttaaagggatagtcccttagttatccacatgatacttttgtctagaataatttataccatgacttttgccagatatttctgatttgtgtatagatggttactgaattcatatagatggaaggatattgtgcataaaaatatgagaatataattttgaggtattttagctcaaatgatctccaaatgctaaaagaactgcaaggtaagggaacagtgagtactctatatatacaattttactgtgggaaaatatacataaaatttaccattctaaccttttttttttcttcttcttttttttttttttttgagacggagttttgctctgttgcccaggctggagtgcagtggtgcgacctcggctcactgcaagctctgcctcctgggttcacgccattctcctgcctcagcctcccgagtagctgggactacaggcgcccgctattgtatgtttattagaggtggggtttcaccgtgttagccaggatggtctcaatctcctgacctcgtgatccgcacaccttggcctccagaagtgctgagattacaggcatgagccaccacgcccggcccttttttcttcttttttgagacggagtctcactctgtcatccaggctggagttcagtggcaccacctcggctcactgcaacctctgccttccggattcaagcgattctcctgccacagccttccgagtagctgggattacaggtgtgcgccaccacgcccagctaatttttgtatttttagcagagacaagtttcaccatgttggtcaggctggtcttgaactcctgatttcaggtgatccacctgcctcagcctcccaaagtgctgggattacaggcgtgaaacaccgtgctcggctgattttaaccatttttaagtttgcagttcagtggcattaagtacattcacattgtgggatgcttaccatcatccatttccagaacttctcttctttccaaactgaagcgctgtaccccttaagcaataactccccatccccccagcccctggcaaccatcattctactttctgtttctgcaagcgtgactaatctgggtacccgtgtacttggaattatgcagtattgttcttttgtgaatgacttatttcacttagcatgatgtcctcaaggttcacccatatcgtagcacctgtcagaatttcctttctttttaaaaaatactaaataatccactgaacataggtaccacattttgttcgtccttgtattgcttcctggaaagacttttaaaagagacacagtattggcttagtagacaaggtgatctccctggccccctacttgccccacacttgggaatatatagtcgctaacctcatcactctcaggaggagatggtagggagtggaggttgtatttattttcgggaaaaaaaacagactcccaggtggtgctgatgaatccatctcttcctacccttttgtgaatagttgaatctgtgttcaagattcccaagttttgcctgaattctagacgtgtagagccaactctctagtggttttcacctcagtttcaatgttaagaactgtacgaactgccactctacccctttccttggaagagaagtggacgggaaacctggagtccaggattatataagccaaggaagctcagagtttcaagaagggagaggtggtcagtgtctaatgatgagaagagggcaaacaggatgaatattgagaagcagttatttgatttgtcagtaagtagaacattgatctgtggaccttcttctcatgcgtcccctaatgcacatactcaaaagctttgtatgtaatttttaggggaattaatcttgaagcccatccctacgtctcgattaagaccttctggcttaaagcagttttagttttagtagctttggatggagccaggtgatgagagagaatggacaaagtggaaggtgagatgggcggggcatggtggctcacatctgtaatcctagcactttgggaggccagggaggagaattgcttgagcccaggatctcgtgaccagcctgggtctcaaaacaacaacaacaaaaaacccaaaatttacaacttacctactttgtcttcatcacatttatttaaaaagaaagagaagggggaaatggagacagtcttacgacttgtgggaaaagggaagggcagacactggtgattttcagtagggaagattcaagcacaggctgggaaaagattgattggggatgatgatgattggagcatcatcccttggagagggtatacaatgggatcatgaccccaagctgagggacaagaaaaagaagaaactggagcagatttgaagtagacaagaataaagttgaattggttagctaatattttgagtgccaagaaaataattattcacatattagccaggtgtggcagcacgagcctgtagtcccagctactcgggaggctgaggcaggagaattgcttgaacccgggaggcggaggttgcggtgagccaagattgcgccactgcactccagcctgggtgacagagcgagactccgtctcaaaaaagaaaataatcattcacataatttgtcagcagacccaaagtggctaaggaaaatgatatgcaagtttctcaaggttttgaaaattgtctgcttcacgtaacactctttgtaatttagggtgtataaaatggataacaaaagcgaaagagggactgcttaaatcagactttttcattttttttttccactttatgtatttaaagagcttctatgtctttagactcaccagtacttgatagtatcagtcttaaaactttgttttgcttcgccagtttgatcagtggaacaaattttggttttgtaatttgcattttcgcaattactaatgaggttgagaggcaggctagtgtagcatttaagagctatggactccctgggttggaatcccattttgccacttagtacttactgatacggtaatttacttttgctctctgtgcctccctttccttacctgtaaagagggatgatactagttcctactgtatacatttgtaaggattacggtgctacaaacagtgcctaacatgcgaaaagctctattttaaaattatgtcttatttcatgtatttattagtcacttctatttctttttgagaagtctatcttcatatctgtttttctacttctccctgaagcttctgaattttgcctagaggaggacatatcttttttgtgtgtgtgacagagtctcgctctgttgcccaggctgcagtacagtggtgccatctcggctcactgcaagctctgcctcccaggttcacgccattctcctgcctcagcctctccaggtagctgggactacaggtgcccgccaccacgcccggctaattttttgtatttttagtagagacggggtttcgccatgttagccaggatggtcttgatctcctgacctcatgatccgcccgcctcagcctcccaaagtgctgggattacaagcgtgagctaccgcgcccagccaacatatcttaacaaatcagtttttgtgtgtgctttagtcaagttttttttttttttttgagacagggtctcgctgtgttgcccaggctggagtgcagtggccccatttcatctcactgctacctccgcttcctgggttcaagtgattctcctgactcagcctcctcagtagctgggactacaggggtgagccaccatgcctggctaattttttttttttttgtatttttagtagagatggggtgtcaccacgttggccaggctggttttgaactcctgacctcaagtgattcgcttgcctttggcctcccaaagtgctagaattacaggcgtgagccactgcgcctgattttaaacatattcctctagcactttctatagttgtttacattttcctcattaatctgcctgtaatttgtgtgtatgtcaggtggtggcaggggttaaaatgtacgtcaacttttttttgacaatgatagagaacttgaagaggaagaagtcttagagtcagatgtgaattagagtccgctctgcataacttaggcaagcccctgctgtctcttatttttgactctgtaaaatggagataatactcaatttctgtgctgcatagactgggtatgagaatcaagtgagttgtggcagagcacttcgaaacttcctgcagtggcttggtaacctaagtggtgaaaaatacttgggtattaatattacagaagcaagcccccaggtaagttttatataccatggtatacatttggttttgaatgtcttaagccaggtcataattagaaaacttagaaatgaaactttgcaatgcttgtgggaagtctctctcaatctcttgagagccagtgagttagaaccaatcagttaagtttctctatctggtggcaccttagagtcattcactgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctggagttcggctatctcacagccaatctccaacggcccccagcttgaacctcctctccacctttagacacttcctctcttctctccttctctgctgtgcttctctgccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatctgtaatcccagcactttgggaggctgaggcaggcggatcacaaggtaaggagttcgagaccagcctggccaatatggtgaaaccccatctctactaaaaaatagaaaaagtagctgggtgtggtggcacgtgcctatagtcccagctgctcgggaggctgaggcagaagaatcccttgaaccgggaggcagaggttgcagtgagccgagatggtgccactgcactccagcctgggtgacagagcaagactccatctccgaaaaaaaagaaaagtgaacataggtcttgcatagtaacaagaaagctcaagtggtgtagatggtaatacttgagtatgtagtccgtctttttctgatggcttatactgtcagtcattaaaattaactaagccatgtgtcaattctaagggggaaagcattaaatcattcagtgtagcctatggttagcattggacccatcataaatcatgacaccactttctaccccataaatacatacaattgtaaattgtcaatttacaataagattataaaaagaacatggacccaagtcatgttgcctagcgttcaaatttcagctttgtaccatacttgcgttatgactctgggttaattatataacctctaagcctcagtttgtttatctgtacaatgagggtaataatagtgtaactacttcatggactgttaaaaggatcaattgaattaatgctaaacatagattttggtattaaggttttatgctggccgcaaaactcatagggtgtacctctttctgttctctggatgaatttatgcgaagtttattatttcttcattaattgtttggaagattttactggtggacccatctggcctggggttttatttatggaaaagttttaattgaagatccattttttaatttggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacacactctctctctctctctctctctctctctctctctcgcgcacgcgcgcgcgctctctctctctctgttccttttgcttactttggatttggtttgctgttctttttctcatttcttgaaatggaaatttagataattgatttcagttgtcttttctaatatatacagttttatattgggaagtattaaattgaatggcaaaacattaaaacttacgatgtacagctcacatcacaacttaccttctatagaggtaagaggtaagttgaggtgtgtgtaaatgatcacaaacatgctgcttccaattattacatgtttatgtagagtcaggtaagtttttaggcaaaagtgttattttgaagtttttatactgttatttggggataagttcttattgtccagctattacagattagatattctatcgtaagtagtatagaaaagagcttctgtctgtctctcctttttcttctttctctgccattttagagaagtgaacaagtcgggggttttttctcccccaaataaatgtgtcagttttattccttttcctctctagttcccattttcgagacataaaatattaaagtgtatggtcacaggtcttggacagagttaagaccttcctgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatcagggggcaaggagttaaaaaataataaagcaggcttccaaagttacatacttcacatcagacatttttgttggacttgtaacacttgacttccgtgctgtagtttcctgtgccttgagaccagctctgtgagcacctgcacagttttactgtgttactgtgagcacctgcacagtgcaccatttagttactaattgaccatatgagttcatgtataaactttgtgagtaaaacatattaatgctggtaaactcatctgtcttcgtgcaagtgcttatttatgcaactctttattttacaactgttaaataggtgcttgaatgataaggcgaggggcccgtttctcttaaagggccatcagcctatagtgaatagaaaattcaagaacacatgaataaaaatcagtttaaaatttaggttagtttcattttgaaagagaaaataccacctgctttctgaattaagagtaaaggtcataaaagttcattcacttagttgtgaaaatattatgcactgttaaaacggggggagagaaagacatgctaaaaatgaggaatgaaagagaaaaatagccacgttagttgaaagtgatgttacttatttaagaaccataatcatgaacttctaaataattattgtttggataatggtttgggtgtagggaagttatggaataattacattttctcccttcaaataaaaaacagaagttataaattactttataatgtataaaatgtgatgtatcatatttgtggaataatttctgtcatggcttatataatgggaaatgtaagcagagaggcagtacacattatgattaagaacacaaactatttagactttgatagaaatcctgagtatagaatttgagctgtgtgatcttgggctacttactttctgagttttttttcatctattaaatggcagtaacatatttcattaggttgttgaggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgttagtagagatggggtttcaccatgttggccaggatggtcttgatctcttttcttttctttttcttttttttttccttttgagacggtgtctcactctgttgcccaggctgtagtgcagtagcacaatcttggctcactgcaacctccgcctcccaggttcaagcgattctcctgcctcagcctcccgagtagctgagattacaggcatgtgccatcacacctggctaatttttgtatttttagtagagacgtcatttcaccatgttggccaggctggtctcgaacgcctgatgtcaggtgatcctcctgcctcggcctcccaaagtgctgggattagaggcgtgagccactgctcccgggcaaccctgtctcttaccaaaaaaaaaaaggggggtggcggggcaatgaagaggtttatcataatgtctcctttgatctgaatcctgaaagagcacttccctatgaattttaacaaaaatatccatgatacctaattagttaatatttgattgttataatagttttatatcctaagttatcaagataatttagttttcttccctctcttattgctgtatcttttgacagtacctgtaaaaatttgtagagacatcaggtggtgcttagtcccacaaagcagataatctgccaaccttgtcttaatattttaatgttattttaatattaatattaaatattttcatagcaagataattataattagtagctcatttgtagtgcctcttttagtgtacaaccattaagcatgtttttgtttggtaaaacttttaggcctcgatgggtggttccagttttgccgaaaggggaattagaagtgcttttagaagctgctattgatcttagtaaaaagggtaagttatatgtttttatgcttcctataatgtatgctactagatgtatttttactttatcccaaaagcggatgaagtggatttgttttcctccatcataaacacatactgcagcttgcaaggaggggctcatatcctttggacattcttaaaggatgtttgtgaactctctgaggtcacataaaatttatatttgtatttctacggagtggattcattgtttcgtcagatttgcaaagaggttgtcactcagaggttaaacatttttaattgagggtcttatctgttatgggaaatactatacaaaagaacattttacaattaagtactctataaatgatggatggtatgatggactccagacatatctgccccctgccctccttgtaattatcttgagtcatttctgtcctcaaaatattactatgtaagtctacaaattatttacacttgacctttgactgctttactgaaatgacagtgaattaggatgtgtggctctttgtactcagtaaaattttacctagtaaaatcttcattcataatccttcaggtaaaaattaccatttcattaatattgtacttctgaaataaactgtctcgcttacatatttgtaagatagggtcttgctttgtcacccaggctggagtgtggcgatgtgatcatggctcactgcagtctctacctcctatgttcaagcaatcattctgcctcagcctcttgagtgggatacaggcatgcgccaccatgcccactaatttttttttttttttttttttttttgagatggaatttcactcttgttgcccaggctggagtgcagtggcgtgatcttggctcactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatatattttggggtaatgagatattttgatacaggcatacaatgcgtaataatcacatcagggtagatagagtatccattacctcaagcatttatcctttgtgtttcaaacaatccagttttactctcttagttattttaaaatgtacaattaaattattttttactgtactcaccgttttgtgctatcaagtaactaggtcttattctaatttttgtacccattaaccatcccgctattctttacgtccgtgagttcaattgtttgatttttagatcctgcaaatgagtgagcacatgtgatgtttgtctttctgtgcttggcttatttcacttaccatggtgaccttttgttccatccatgttgttggaaatgacaggatctcatttgtttttaatggctaaataatactccattgtgtatatgtaccacatttcctttatccatttatcagttaacacgtaagttggttcaaaatcttggctattgtgaacagtgctgcatcaaacatagtagtgcagatatcgcttcaatatactgattttctttcttttgggcatatcagcaaattttggaagacttctttgctaagcatgttctaagtcctgactgtaaaatgatggataaacactgattaatggtatttcatttaatagcattgacattcagtggacatgtattcctccctccaccatattttttttctgagaccacggttattttcaacaagttccaaatttttaaaagtttaaattaccatctcttttgtactatcaatcaaataatactttctgtacaaattgaatagtttttatttggtcattaagagttacagattttctttgtttggaagcacattgctctgttgcctttctaaaatgaggtgaaattaagcaaagatataaagaaacagagacactgagataattgagagaggctaataaggaagacaagacataattcattttatttgatcaaacacagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttggccaggctggtctcgaactcctgtcctcaagtgatccgcctgcctcagcctcccaaagtgctgggattacaggtgtgagcccccatgcccggcctctgttcttttgtatactatggaaatggtcataagttgtcaagcagataatatttttgtggcctataacctatttcccaaatatgaccatagcataaaaattccacattttctgatttaacatgtaattgtataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttaaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttactttttttttttctctatgtgccagtaatccacaacttaagagattcacagggcacaaaacttgatttaacatggctaaatgtaaaatttttagatgacttctggttgaagatagttttatatctttgaaatatagttcttgctattaaacttataaagtgtagcgattgtgagagtgttagcctttcaaagccttcaagagtacaatttttaaaaatatagcccaaaatatagttgcgaatcaaggagaagcatattctatggagttaccttcacatttacttgctattgaagtaagagaaattttatcatacagctaaacaggtcttctataagcttttaaaaatctgattaaaaggggacatgtttggcagcatcttcaaccatgtcctagttgaatgcagatgtcatgatataatgaaaaatctaagagatatgtaatagcctccatatgtttttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgacaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccagagaaggaaagctgttgttggcagctgctgaagctagcctattagcctcagtttgaagcactcttatctgaatattcccaattgtttaagcatacattgcagccaaagaaatacagaaagattagctttagactaattctttactgtgtccacacctgctgttttataaatattgtatgtaactatcaagtatatcaatctaatagtctcattatagttactgaagaaataaaatatattacataatgagcatgtactttcttacaattgctgaatgacaaaagggatctggtgaattaagtactcgagttttaatggttttgaattagcctttcatgactaaaaaggtaggaaaacactattaaattgaaatacgttaatgggtttattagagaaacttagttcattcatattcttttaaaaccatataaaaactagcagtaggccaggcaaggtggctcacgcctgtaatcctagcactttgggaggccaagacgggtggatcacctgaagtcaggagttcaagaccagcttggccaacatggtgaaaccccatctctactaaaaatacaaaaattagccgggtgtggtggtgtgtgcctataatcacagctacttgagaggctgaagcaggagaatcctgcttgaaccctggaggcagaggttgcagtgagccgataatcacaccattgcactctgggcgacgagagtaaaactccatctcaaaacaaaaaaacacacagaaaaaactagcattagctatcatattttctctttaaacaaacattgaacatacagccatttagcatctttactttttcctgtattttttttttaaatagctgtagaaattatttttgcttaaggcttagaagagaaattgtgtattttgctccttgttttccagtggcttctaaaacatggcctaaattttagaaggtggcaaggtgtgaaaggttttcttaggtacattaatttctacatatatttgattcttatatttatatagccttttaattcattttaggtttttacatacagacaggcttttagcctcacaactgttgtctgtgccagctgtatggtactttgagctacagctctttcttagacagttcatcctgttgcatggtgttacttctaagataaggagaactgggtgcaatttgtataagcaaaagtatcaaccagcatattctacttaggaacagtagatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagcattattgagttgtagattataaagctttgtttttttagtctataaaaaccaagaaaacagctttgcctttgagtgcttaaggttccagttttgaaacaatattgttagtgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaatttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactgcaaagataaagacttccgaaatgatgatacgtgaccagtgatgcctttgatgagagaaggaaaaaaaggggttgttattatatctgctgtatcccccctcttctcaggatagtctaaatacaataatggtctgaatataataataattcttcatgttcttccccctttggcttaacatatgtttattgagcacttgtcatttggtaacaagcacttttttcccaaggtgttggtaaatctggcaattcttatggagtgttgaaagtttctgctaaagatgattttgaaaggaagcaatgaagtctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttgggtgaatgcctgttccccccctccccccaccgtggcattatttgtatattttttggattgtagttcttgatatattttgaatgctaatctttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttccagttgtcttagatcatacatcttcattttagaagtgagttttaatcaggatcctggtgcagtccatgtgtatgtcttttaagtctctttgaaactagctttcttcttttttacttcccttgcaatttatttgttgaagaaactggattgtttgttgccttggtgtctgtcaatagttttgatacagaaggttttttttttttttaattttactagagcatatctcaagtggtggtgtgcttttccttgaggaggaatacctagttgtctctctttttataatgttagctagaggtttttaattgtaatctgatattttagtcttacatttttagcagttgtcatattccttttgttattttgtgtaggctggaaggaaataaaaacaggcattcacatcatctttgaagacgtaccatattaataattccattgaactaatcttctctcattaacttaatcgttgttttttttttttttttttttggagacagagtctcactctgtcacccagactggagtgcagtggcgcgatcccagctcactgcatcctccacttcctggattcaagcaattctcctgcctcagcctcccaagtagctgggattacaggcatgcgccaccacgcccagctaattttgtatatttagtagagatggggtttcaccatgttagccaggctgatcttgaactcccgacctcaggtaatctacctgcctgggtctcccaaagtgctgggattataggcgtgagccaccgtgcccggtcagcttaatcgttcttctgctgtttgacgttaagttcgtttcagtttattttctaataaacactgatcagcaacttagtgcatttgctgctgctataacagaacaccacagactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttacactgatgaactggtatttaggtaagagccaagaaaagctcaggaaggtgtattaatgtagatactactcaggttttgactatgtttacttgtgacagttcggtaagtatttattcagcaaattaaatagtaataagggccttgagtataaattatttcattaaaccaagggtccttctgaggagtcttgaaatcagagcagtacatttgctatcagggcttttaactagtaacttcttttttaaatatctattagtatcagtgcctggcatagtgatgtacacattcattcatgaatagttactgagtttcactgaatttagtagactgttgccttttttcaacttcaactttcatttattgtttgggaaaaaatttttaaaagtcattttccaactgtcaccttttcccttctgcttgccaaaactgttgtcaaagtgtacatttgatcataaatgttttcatggccttaaaaatgtacacactattaaacccaacaattctacttagagaaatttcttctcggaaatagtgaaaaaggatacaaagaggtacccacaaggacattcattagtgtttatggacatgaacatgtggaagcctcctgaataattactttttttttttgagacggagtcttgttctgtcgcccaggctggagtacagtggcgcaatctcggctcactgcaacctccgcctcccaggttcaagcgattctcctgcctcggcctccccagtagctgggattacagacacgtgccaccacacccagctaattgttttgtacttttagtagagactgggtttcaccatgttggccaggctggtctcgaactcctgacctcaagtgatccacccgcctcggcctcccaaagtggtgggattacaggcatgagccacagctcccagctgtgaataattactaatagtttatacaaggttcgattatggcgccattaaaaggattaatatcacttaagagtatgattctaattttgctgccgaaaaaggaatatctgtgtattacaaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatagagataaacactgtaagaaattgagacatatatctcgttaacaataatatttgaggagcatattttgagtatgtttggctcatcgtacatatttcggcctttctcaaatgaatgcatttatctttcgaagtagacacagtagttcacatactctcccaagaacagtggccttgtctcccctaaaatagtagtagtggatgtgaaagttgattggtttcagtgaaggtagcaaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggcttctcagtatatactgttcctcttctgtcttatgacaaattcatacccctttccccactgatactttgttgtttcaagtttgtttcccgagcagtatgtaagaaaatactgtattacgaatgttagttatagagttaaacatactgattactcaacttaccattcatttaacatgttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgaggaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatacgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctagaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaatcccattagctatgaggcattaggttacttggcatgataacatcaggctttcacagtttactgatattctcaatttctgataaccattttaccaatggtttgtgctgcctgtattttatcttcactagcatctttagcttttgggggaaaaacatttcctcagtaagcatgatcagctgattttacctcctataaacattatttagataaaagaatgaacttagtaaaattctctacagtatttactcatgttctcactacaagtgttttcatacactggtacttaaattattctttaaaagtttttcatatgcatacaatgaagtataaaccaccttttagttttcactcaagttttaactcattggtagaatagtcattctactgacttcaatacttaccgaaagtttaatttaccattttttcttgtttctggatagagttggatgacccaacttcactgtaggtcagatttttccactctgtttacttaggatgctaccttctgttacttcttcccggtcttttccatccaacagtaacagtttttaggaacgttttccacacaaaaagattgctttatgagtgtcattcaccaacagtgctatgttagggtgcagatcctgtgctagattttctcaggactcattccttacatcaactatgaagtactattaagtctgtgtgacttctctgtggtttaaaaataattacatactatccattttgtgaacaatttgtaccttcttggagaaacggctgtttccaggcgtggaacagggaaagtaccacatgatccttgaccatcctattccagaaagtaagaaagtgctcaacgatcatgttgacatgtcaaaaggacacaggagttggctttcactggccataattaggtcaaaattagtaatgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggagaaaaatataaacaatagtcatttagagtacctgaaaattgtcctaagagggagtatagcaaatgggaaaacactcaagaaaatctattaaatctgcaaaacagcaagagtctgtagcatttgagccacagcttgttctgttctcccatgttcagatccagctttcttgtgtggaaactctactccaggcaggtgtgactaagaagcaggggctccttccctgaggctgccagtctagggctgtagtttgaccacatgaggtggtgtgggctactggcatttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcctaagggtattatcacaaatggagatttgggtgatgaagaattaggagagtgcttgtggctcccttatactggtatcagcaagtcacaggatgagcaaccagaaatttaacagaaagatctagataaagagatggccaagacaagctctcttgtgatcacagtcaaccctgggggtcaggaatgctacgtgtatgcattaggcttcacctaagcagaaacaatcagaactggacacgggacaaattgaaaacattccccaagcttcatgtcaatccgtcagcaaagggtgaaagcctcaccagtacagtggacttaaatacagctctgaccaaacaaagcattgggtgaataataagctaccccgactcaggggcaactcttaggaagccagacatgaaaattacatgtatccctggcagtctggaagacttgctgcatccttgctggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacagacatctgtggaatactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcctcccttctgtgttactcgccacaatgcttagactgatctaattatgacgaagtggcatggaagcccaaattgagtgacatttcaacaaaattgacctccagttttcaaaaaggtcaaagaacacaaaggatgattaattctgcagattaaagaatagaaagtcatgaaaaccaaatgcaatgtatatttaatcttgggctttgtagaaaagatgtaaaaggacgttattgggaaaattgatgaactcgaatatggaccatggattaaatcagtgctcctccgagggggtggaggtggctatttgacagtgtctggagctgtcttaaactggggttgaggggtgggtagaagcctggaatgttactaagtaacctatagtgcagtcctagacagaacagtcctgtacaacgaagattacctggccaaacgtcagtaacggaaaccctgggttagatgatggtagtattttactagtgtagttttcttgttatttggaaatactcattgaagtatttaagggtaaaaggacatatgtccaactcttaaatggtttataaagattatgcacacacgtgtatgtgtgtattttttacatgtgtggcaactaatgaagcaaatggaggaagatgtaaacaattggtgaatacaggtaaagagtataagagaattcttgcctttttttttttttttttttttttttttggtgacggagtctcgttctgttacccaggctggagtgtagtggcacaatcttggctcactgcaacgtccacctcccgagttcaagcaattctcttgcctcagcctccagagtagctgggattacaggcgcctgccaccatgcctaatttttgtatttttagtagagacggggtttcaccatgttggccaagctggtctcgaactcctgacctcaggtaatccgcctgccttgccatcccaaagtgctaggattacaggcgtgagccatggcgccctgcctttttttttttttttttttttttaaagagacaaggtcttgatgttgcccaggctggagtacagtggtgcaatcatagctcactacagccttgaactcctgggctcaaaccatcctctcacttttttttttttgagacagggtcttgctatgttccccaggctggtctcgaactcctggcctgaagcaatactactgcctgggttgggcttcccaaattgctgggattacaggcatgagctaaaacttgattttctttccagtttcttaagaaaacctcttgaagtagtcctttaagtcccaatctctgatgaaatatgcattcctgaaagtagagtgtttatgcctgtttgcatattccaatatatgtggaattagaaagtagtttggtcgtaatatatggggcttttttctttaccaaagcatcaaaaccaaatatgtttccagacattatgaatgtcccatctttataacacatcaggagtttgttcagagaagaaacatcaatgttttgaagaatttgattactgatttccaaaagagcttacataattagaatctttaacaatagcttgcacataccatagggtctgggatctgatatggaaatatagtaattaatgctgaaggaaaatgacacattctggacattaacatggtaatggtgacaattgtatgataacttggtcatgtagagtagcatcttgtgttaccctcacttcttaggtgtaaattagtaatatttatttttataccaaaataattttttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgattgcaccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatggaaaacctttgaaaagttaagcagttttaactcataaatattgatggattagttatttgtgaaagtcacttgattgaatacctcatttttcaatgatgccatataagcaggctgctaagtcttttttctggttgttgttgttggagacagggtctcacccaggattctctacttaaatatgactgttgttaattgagtgctacaattaaattagccattgccatctttaattggagtgcagcggcacagtcttggctcactgcaacctccgcctcccgggttcaattgattctcatgcctcagtttccccagtagctgggactacagacatgagccaccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaacacatcttaaaactcaaaatttgcaccacactacaaaagtaaactgaattgaacaaggaaaatatgttttcttacttggtctccccatgcttatcccctttcccctccccaacccttttataggggccaacactgaaacacttcctcaaagtcccctagggttctgaacatagtttggaaaccactaatgtaattagatgagtgataaagatttatagaaactgggggtagagtagtcctttatgctaaactgtgtttcatgtaatctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacctttccacctcagcctcccaggtagctggggctacaggcacaggctaccacacctggctaattttttttgactttttgtggaggtggggtttcactacattgcccaggctggtttcaaactcctacgctcaagcaaatcctcctgctttggcctcccaaagtgctgggattataggcgtgagctacagtgcctggcctgtaaagagctcttaaaagctgccttgcatggcatataacaaatattttcaaatggtgtttatagttttgggatgttttgtgtagtcaatgccatcattttttttaaagagttttgtttattaatcatgaaattatatacagttgcttcttgaatatgatttttattttgtattttactttaaaaaaggtactataccaatataaatagcattttggagtgaattttgatatgaaggcttttttccagaaaaaaaataaagtgcattgtggcatttttgttgatgcttttaacaaaatgtaaaacgaccttttaaatgtaaaaggtaaactctaccttctttttttgaatttttttttttattaatacaaggtctacctatgttgtcgaggctggtcttgaactcctgggctcaagggatcttctttgcttggcctcccaaagtggtaggattacaggcatgagccactgcgtccagccaaccttttacatttaaaaatagtcttagtgagttgggcttttacagcataaaaataagcgttatatcttggatttaatttcattttagtagacacctcattttctgcaaccatagatacaagactaacaacaatagaatatgattatgtttttaaatattatttatatttttagttaaaaggagcaatatttttttttcttttgcatttcactcttgttgcccaggctggagtgcagtggtgcagtctcggatcactgcaacctttgcctcccaggttcaagcgattctccagcctcagcctcccaagtagctgggattacaggcgcccaccaccaagcctggcttattttctgtatttttagtagagatggagttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtacagttaggcaccagataatgacgtttcagtcagtgatagaccacatatacaatggtggttctataaaattataataccatatttttactgtaccctttctatgtttaaatacacaaataccattgtgttataattgcctacagtattcagtacagtaacatgcttgtatgggtttatagcctaggagcaataggctataccatatataacctagatatgttgtaggctgtatcatccagatttgttgtaaacacaccctatgatgttcacacaatgatgaaatcacttaatgatgcatttctcagaacatatgcaacacgtgactgtaatctggagataatttatacaggaagatgtgcatcggttgtatacaaattccacatcattttatataaggtatttgagcatccctggattttggtgttgggagggtggatcctgaaaccatccctgcacccccaccccccatggataccggggaataactgtattgcatttagttaatgtatctctttagtttccttctgaaacagttcctcatactgtctttgaccttcatgaccttgactcttaaagattacaggccagttaattatagaatgtccttcagtttagatttgttttatcatgattgtattcaggttatgcgtctttggcagaaataccacagaagcgatgttctgttcttctcaatgcttccagtcagatagtatgtaatttcaatttttcccattactgacgatgatcactgtgatcacttgagttttttccttgcttccccactgtaaaattacccttccctttgaaagtattttgggccaggcacagtgactcatgcctatcatcccatcactttgggaggccgaggtgggcagatcgcttgaggccgggagttcgagaccagcctggccaacatggcataaccccgtctctactaaaaatacaaaaattagccgggcgtgttagtgtgcacctgtaatcccagctacttgggaggctgaggcttggacctgggaggcggaggttgcgttgagccgagatcatgccactgcactccagcctgggcgacagcgagattctgtctgaagaaaaaaaaaagtattttgtgcagaggtactttgaaaatatttatactgttcctcatcagacattttattcattcgtttatatctgtatgaaatcatgatcaaggagttataatctgttactatcatttatcttgatgctgaaatgatctcgtttggccagtgggagtcctttcagactgttctgtgttactttaatatgttcccattattctttcagcacttgtgtgctctttggctcaagatgtttaagattaggtcaagtgtagtggctcacgcctataatcctaacactttgtgagggtgaggcaggaggatcactggagctcaggattcatgaccagcctgggcaacatagccagacttcatttctattaaaaatttcaaaaattagccaggtgtggtgatgcgcacctgtagtcccagctacttgggaggctgaggtgggaggatcacttgagcctgggagatggagactgcattgagctatatgatcaagccactgtactccagcctgggcaacagaacaagacgctgtctcaaaaaaaaaaaaatttaaaaaagttccagattaacatcctgtaccctctctgccccagtcctgaaattggctgtttctccaaggaggcctgtttgatttattttcctggagaatggtgtttagaaaccaagatctggacatttattgcactcattgctatcgatgtattgttgctccctggctctctaagcagttagagctaaggaatgtgtgtatgtgtatccacatttaagtctattactatatatatacacacacacacatgaatatatatatgtgtgtaagtttttacaaaaccatggggtcacacgacttcctcccatcccagcctatcacagtttcattctagttttctccctttctatatttgtaattttttttttttttgagacagagtctcgccctgtcacccaggctggagtgcagtggcgcaatctcggcttactgcaacctccgcctccctggttcaagggattctcctgcctcagcctcccagtagctgggattacaggcgtgagccaccatgcctggccaaactctcttttctgacaatgaaaaacctggcttctgttatcctctcacttattttcctatttaatcagttatctccagaccccccaccctttctttgaacgcagaaggactcttgtctctgaatgttgggtctctaccccagggacactcctcgctctgcttgagttgaatctttatgctgagctctacccacttattgggctccctcctcctccttcatggtctgtaattcccaacataggactacctttaaaacttgcacatagtttaattagagcactcataaaatgataattagtatcctcagagataatttggacagtccaggcaggtacttcagtgtggctgaaggcttcctcaggagatagtaaaaagacacaaaaccagtacagaggaaatgctgacttgacattgctgagatacagtgcaaaagagtggagctctgagatagatgggctaccattaagataggcacagggggaagtagaacctgccaaggtccatgaaagtctagtttaggattgtatctcacaagatgagcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaaatcacacatgaacaaactcaccttctgcattatactgacatcattatatttgccaattgattgtgagctaattggggttatagaaacgtgctatagcataacagactgtaattatttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaatttttttaaggtactttattgtactttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccctcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtcttttgcccattttaaaaatcggattttttgctgttgagttccttatatattctggatattaaccccttgtcagatgcatagtttgcaaatattttctccaattctgtagatttgtctttttgtggtcttatttcctttgttgggtagaagctttttagtttaatgtaatttcgtttgtctgtttttgtgtttgttgcctgtgcttttgaagtcttagccaaaaagtccttgcccacactaatgacatgaaacatttcccttgtgttttcttctagtagttttatagtttctggtcttacatttaagtttttaacccatcttgagtttatttttacatatgatgaataataggggtttagtttcatttttctgcatatgtatattctgtttttgcaacaccatttttattcaagagattgccttttcccccaatgtgtgttcttggcacctttgttgaaaatcagttgtttctgattatgtggatttatttctgggttctctattctgttcaattgatctgtgtctatttttgtgtcaataccatgctgttttggttactattgctctatagtaaattttgaagtcaagtagctgatgccttcagctttgttcttcttactcaagattgattcggctatttggagtcttttgtagttccatatgaattttaggagtgttttttgtatttttttgttttaccttgcagattcacctcaaaggatgttttttctatttctgtgaagaatataattggtattttaatagagattgcatcaatctgtagattgctttgggtaatatggacattttaacaatatttgttcttccaacccatgaacatagaatatttttccatttatttgtgtcctgtgttcgttctttcatcagttttttttgtagtgatctttctcctccttgcttaaatttattcctaggcatcttatatttttgtagctattgtgagataactttcttgatttctctttcagatagtttgctattggcaaatggaaacactacttagttttgtatattgatttttgtatcctgcagttaactaacacaggttcacgcttgtaccagtccagcttcctagtcatcttccattccgtatttgtatctctacagcaatgagaaatctgaaacctgagggagttggaaaggcttcttaatcagtcttcagcctctgtctttaggccttcgaatcatttgtgccttcccaagtgtttgttgttttcatacccttggcttttctcagatttagtggggcattaatttataggcaccctcttctccttgccttcacaacaactaaaccaacttcacaacttcagctaaaccaactatctatccccatcttcactacaccgtcagtaatttgttgacagctgtttaatgtgttgcttccccttctgtttttatgttcttttgagtttatgtatttttatattcattcattctcattttagtggggtttggggatgaagtactgataaatatagtgcagtacaccatatttagttgacataatttttaaagctgtcttctgcttttattacctccattttctaaattaaacaccttgttgggcttctcatcttgctttgcaattattatgggacagaagcatttcacattagattcttagctaaggcttctctcaaaagatatatttcattcttgtctgttacatcgtttagaatttacatagtttcatttgttagtatttcagtaatagtccttgcagtgctttactgcagattcaaccttcacaacatactgtaaaaacacaaacccaccactgaatccttgatcttgtgattggcgcttaatgccaccagatggcgagcatgagctcttgtcagacagttaaggcaagaaacttgaagtgggtgctttcttcatgttttatataatgaaactagaatacctaaatttgaaacagccagcttttgaaaaagctggtaatggttgtattgcagcagaaaatcataggctttggactcaaatggacttgagttccaatcctgcttctaattgctactctatggcgttaaacataagtttcatagtttattagagcttccttatccttagaactgggataatgataacttttttgtgtaattgcagggattaaatgaaacaatgtatggaaaacccctagcctagggactggcacttagtattcattaaacattaaaccactctctgtcacttccttttcttagagctcctgcttcctttcttatttaagagtttgtgtctaaaacgtggtaatacaatcttttgtaaaagtctgttgtaagctcttagcactgataaactcaacttaaaccacacatcatctctataaggtatagttaatgactaggaaaaaagctaatgattctctctttcccctccatttaaaatacatccaagagtgcacaaatgctaaatgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagatggacgccaccacgcccagctaatttttgtattttttgtagagatggggtttcaccatgttggtcaggctagtcttgaactcctgacctcaagtgatccgcccacctccgcctccctgagtgctgggattacaggcatgagccactgcgcccggcccacacctggcttattttgaaaatttttttgtagtgatgggggtcttgctgtgttacgcaggctggttttgacctgggctccagtgatcctcccatcttggcttcccaaagcttaggtatcttttcaaaaggctagaaagaaaccaaaatcgtcataaactctggatgacaagattatgactggcttaaatttttctggcttccattttttataaaatgtaacatgatataatcagggatgaatatgagagctggaatggccactgagtgttaactttgattcagatctctcaaatgagtaaactataattcaagaccattaaatgatttgcttagaattcactacttctgaccgggtcacgctggtaatcccagcacttcaggaagccaaggtgggaggattgcttgagcccctggagtttgagatcagcctgggcaacatggcataactctgtctctacaaaaaaatatgcaaaaattagctgggcatggtggcacatgcctgtggttcccaactactcagaaggctgagatgggaggatcacctcagcccagggaggttgaggctgcagtcctcacgccactgcacttcagcctgggtgacagagtgagaccctgtctcaaagaagaaaaaaaaatatccaccacttccttttcttgagctcttctttttttttttttcctcctactcccctttgcctccatccttcactcagaatatttttaagccaagcaagatactatgagatacagtggttaagcatatgaattgggttgcttttagggagtaatttgacaatgtatgtcaagtctttgggcattatgttcaacttctttatgcttgcagggttttgcatggtgaaaattataaaaattcagctgctaggatctttgatgtttaaaaaggtgaggggaggtaaaaacctaaatgcccaataataggaattaaactggtaaaataatattgtcattttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctcctgcctcagcgtcccgaatagctgggattacaggcgcatgccaccacgcccggctggtttttgtatttttagtagagatggggtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaaaatggcttaaattttatattgttttgtatcacaggtcccatctttgttaggatttttttttttttaaagtagttcttattaggtaagtaaaaagacagcttcttgttaggataaaaacagatttttgtcatgatccctgacacagatacttaatgaagtacacagaaaacaattacatgtttccactttcacctttcttcagtatttattcagagaatgtgccactatggatacagaggtacataataacctctaatctcaacgagctcacagtagggagcccaatgcaaacttagtaatatagaaatatcttaaaataatattgttgaaatatttacagtatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagattcggtgaattttgacatatatgtgtgaaaccactgctgcggtcgaaaccgaatgttttcatcactctttatgcacttttgcagtttattctttccccaggtaactactgctctttttgtccctagagagtattttttgtcttctggagttttatataggtggattatagtgtgtgttcttttgtgtctggcttctttcactaagaataatgactgagaattacctgtgttgtgtggattagtagttcattcctttttattgctaactagtacccattatgaatattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaaattatctacagaagagaagctgtggttggctttttgatttatcatgtgtacctgcccctgatgctacatatttagaaggagaaattgagttacaggaacttccctgacttggtagagcttcttttacatggccaacatcaccctgatttgcccaggatatatgttgatgttccatagtatctgtctggcacagccctgggtattcattcagcttattaactgaatacttattctgtttcaggcatgtactgtagttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgttttcatttcaagagcatttaatcagtggcagtaattttgttttgggtttctttttctgcaagtcagtcagatttatagaaaatgttggtttccatcctcttgtatcagtctgatcctgatcttcgtatatggtaactttattaacttgggctctaatttgtgtcactgttgtatgtaattaacttgttttatctgtattttgtgaaaagacacagaaaatgtttactttcatcattccatcacatgccattcaataatgacaaaattcattgatgaaaggttgatgtaaattcacaataagtcatttgttgaaatgaaacatagtaataattaaagttttaaaaatgtacatgctgtggggggtagggttcaacttgcccactcgagaggatgtagagtctgaagtgggaatgtcactttagagtctaaagtgatttagtgggtttaaagtgtgaatatcacctattttaagaaggtccttgggtaagttctttgaagaaatccagtccagcctattcagaaactcttaacaggatccccacaaatcgggttgggcgtgctacctccttgagaagacaatcctgcacgttggaaaagataaataggtttagtaagtctaattccatttaatgatgcatacgtgtgggaatggtgaggataggaaagatgattagccaacagttttaatgatgtcaaacctggagggtagcaagtttgttattctatgttgaatttttaaaatcttaaattaggaacttatttcatctcttagtctactaactattaaggaacttgatttaacagggttttttgccctctaccctttatgaaaattacccttatataagtcagaaccattttgcccctctcttccctgaaacttgcatgcagtgcggtaatgtactgtagaaagcatgttatctcattatgtcaccatattgtctgcaataatagggagggcgttctaagttaggatctttttgagttttaagtacctgattttttataaatatctgaatacctatgtaggttcaaaatccattatttcccgttagtaagaatttgtcagcaagtccgacttggacattaattattggcattaatattctaaaatctgaatccccaggccgggcacggtggctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatctttccatgtcttcccgttatctttgaattaagttcaaacttttaaatttggcttataagcactccataatttggtccctgcttctactcattcagaagtttcaacttaaatgccacatattctagtaacttttccttatccctaatctaggaaaggtttcctagacctctgttcctgttagatggtctgcttccacatcatgacactgactttattttattgtagttagttgcaatggatttaaattcttttagataaacgatatttttttctgctgtttccacagcctgttgttttattccctgcctagttaactcacttatgttacctctctgatccgagaaagcatttgactttgccactcctgggatagtgctttcagagcagagctgagtatttggttaaatgtttagaaaaggagtcaaggataatactgtacaggaggttagtgggagtcagtttgacagaaggcctatggtgctaaggtctaagcagtgtttgatgttaatgtggtgtaggcagtctcatgtatatgtttggtaaatattgatcaaatacctattgtctacaagacactacccactgtggatatggcaaaacagacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtgtatgtccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccggagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttcttttgaagcactctagaagtctgcatttgctcagggaagttctatcgggtattcacgagcatcaactttttattgcccctcatatttgggctgtatacctagcttattgaaaaattagtaaaccaaagcagtgggaatagcatacctttgaaaatctgattaagttatgggcttgctcccagaaaagtagatacgcctgactttggtttacttgggttccccccaaattctacctccaaaaattttaggggcttctgaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtgtgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcagaagtggaagtactagatcatttggtgatgctatttttattttattatttattatttttttcagacagagtctcactctgtcacacaggctggagtgcagtggtgctatctcagctcactgcaacctctgcctcctgggttcaagcgattctcctgcctcagcctcccgagtagctgggactacaggcacgcaccaccataccccgctaatttttgtatttttagtagagatgggatttcaccatattggccaggctggtctcgaactcctgatttcaggtgatccacccaccttggcctcccaaagtgctgggattataggcatgagccaccatatgcggccaaattttttgaggaactgttttctagagtgactgcaccattttacattcctaccagcattgcacaagagctccaatttctccatatccttgccaacacttgttatactcactcgttctggtagttgacaccctaattgagtgtgaggtagtatctcatggttttgatttgcatttaccaaatggttaacgattttgagcatctttagctgtgcttattattggccacttgttgatcttctttgtctatttttaaattgagttgtgttgttgagttttaagagttctctgtatgttctagatattaactccatatcagatatgtgatttgcagatactttcttttgttgcctgtacctctgatgtcatatccaagaaatcactgccaaatccagtgtcttgaagcttttgccctatgttttttttttttttttaacagttctgtggttttagctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacagtaacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggccttttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaatacagtatttcttcagggttataaaataacaatattttattttttcatttaatagctagaaaagatctataaagggaaaattgccctcaccattttctttttaagttagaaaactcagattacatttttatcttgtttcctttgactttaagtcagtactacgtcatgcactgtgctaaaataactacagtacaaccacgtaactcttactgtgtatgaaaaggggtataattctttatagcagtgaggtttggtttgttttgttttgtaagtaatcctccttggaatcccttcaaggtgcttcccggccagctgagaggagcggggaacgaagggtcacctgatactctgatccgccttcccttcttctgacaaagcagtataaatttcttttcctcccctaactaggccctctacttactctgtactagtgtcttgcgtggaccaccctccctcccatctctcattttgcttttagtcccgtcacccagcataccattctccctcctctctgactatttcagttctgtcttctttccctaggttattccaattccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcgtgagccaccgcgcccggccttttttcttaagttgatagtgaagttgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttagagatcgaatctcttgttgcccaagctggtctcaaaactgctgacctcaaaatcagtcgtcacacctcaacttcccaaagtgttgagatgacaggcgtgagccactgcgcctggcctactcttacattcttttacagaagattattcctgaggaaataaaatggcattttgcatatagctacaggtgttatttataaatttgccctttatcttagaacttgagtgattataatagtgtaaatacagtaagtttagaagatgacaaagctatggtagtatttcctatacaaatgaaataatgacttttaaaatagcattgattattgtcattatctttaaggtatatttgtatacaaaacatatcaaacctattgtaaaaaaagattttacccccgtccgggaggtgaggggtgcctctgcccggctgcccctactgggaagtgaggagcccctctgcccggccagccgccccgtccgggaaggaggtgatggggtcagccccccacccggccagccgccccgtccgggagggaggtaggggggtcagccccccgcccagccagctgccccatccgggaggtgaggggtgcctctgcccggccgcccctactgggaagtgaggagcccctctgcccggacagccgccccgtccgggagggaggtgggggggtcagccccccgcccggccagccgccccatccgggaggtgaggggtgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttaggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcaagaaacacccaagaatgatcaattaaaaaaaaaaaaaaaagcctaaaaaaataaaaataaaaaaagattttacaagaaaaacattgacaaaacaaattgtttgacttgaaaattgattaagggcttctattagaaatagttaatgagttcattactgataaatatacatgcctgtcatatggaagttttactttgggacttgttataatatggattaatgttgatttgcaatcgtttttcaccaaaatgtcacagtaagatagtattttctacaatccaaactgtattaaatatagtcatgggttgagtacacatgtggtttgtgggggtgttttgtttttgattaccaggaaatgattgggtgagaggtaatactatataaatgagaaatttctagcaagttatagtcttaccactcattcataattagggaatatacttattcacttagcctaggcaacttttagtccttttgaaaggccttttatattaggtgaacaataaaataaaattttaaccttgtttttaattagtgataaaaacagccaactttggggtcatttgttcatgttactcctccttagttttagacaattttctaaattatttggaaatcactggttttctttggcaagtgaaatgtcaaaagattatggtcttgaaatcagatccttatacctgatcaacagctaaactagtcttatttttttaactagctgggcatgggggtggactcctgtagtcccagctgcttgggaggctgagtcaggaggatcgcttgagcccaggagttagaagttccagtgaactgtgatcatgccactacattccagcctgggtgacagagtgagacctcacctcattaaaaacaaaaaagaaagaaactctactttgagtgcccatacaaccattctgtttttcactctcagtacagtattcattgaattacatgaatctttgtgttacaagattttgcccaactgtaggctaatataagtgttctgaacacatttagggtaagctaggctaaagctatgatgtttggtaggttgggtgtattaaatgcattttcagcttatgatattttcaatttatgatgggtttattgggctgtagccatttcataagcaaagagcgtccgtacttgctgcagagaccatatgcttcacaaagcctaagataaatttactatctggccctttacagaaagactttgctgtcctctaatgttagaacaccttctttttatagatgttgaagaatatcctacttttgaagtgtagtctaagatctaacttttttccctctatgggctgttccctgattatatagtaaaaatttgcttaatacctgctttatattccattcatataatttataaatgcctttgtgtaccttttttccggagtttaaaattccttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaatcccagctactcggaaggctgaggtgggaggatcgctggagcctgggaggttgaagctgcagtgagccatgactgtgccactgcactccagcctgggcagcagagcaagaccctgtctcaaacaaaaccaaagattacaagatgagactgaaaagtgtaagctacttatgaaatttattaggttttagcttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagaggattgcttgagcccaggagactaacctaggcaccatagggagaccctatctctacaaaataaaattttaaaattagctggatgtagtggcatatgcctgtagtcctagctacttgggaggctgaggtgggagaatcacttgagctaaggaggttgaggctgcagtgacccgtgattgcaccactgcactccagcctgggcaacagaatgagaccctgtctccaaaaagcaaacaaaccaaaaagtcatatatccaaaatgaagttctatatccaggcgtacctgtcgtttcaggttttttttctgtgatcttacttaatcaccattggatccatggcccttttaacataagggagattgtacttttcatttgtctatttagtttgtcttcttttcccttgtcttttccgtaattgcagatatttgggtatttgtagatgagaaagagaatatttattacacagacaagcataagtggaatctgtatttcaaacttaaaaatgccaaatttagacattcagaagaatcctattctgttcaactcttttagatattgcctgttcacaaagcacacatcattgttccataatgtaacctacttgtaaaattttcctgctgaaaacaaatactgtagggcctgtaaaccttaatatgaagtccttaagatcagatatgcattgggattgagaattgtttggatttaagaaaagcaaggcagtgcatataccaacatctctatagcagggtctgagacaacaacttacaattgaacacattaatatttctacagtaaaatatgaatatttatactgaagggagaaataaagactataagtagcctttagtcagtttgggctaggttatcccaccaaccacattttgacagcaacttaatgaaaaactttgttgggctgggcgaggtggctcatgcctgtaatcccagcactttgggaggccgaggcaggcggatcacctgaggtatggagttcaagaccagcctggcaaacatggcgaaaccccatctctacttaaaaatacaaaaattagcagggcgtggtggcgggcatctgtagtcccagctattcgggaggctgaggcttgaatctgggaggcagaggttgcaatgagccaagatcgcgccactgcactccagcctgggcaacagggcaagactccgtctcaaaaaaaaaaaaaaaacttgttataataatagcttttgggccaggcgcggtggctcacgtctgtaatcccagcactttgggaggccgaggcaggcagatcacaaggtcaggagttcaagaccagcctgaccaacatggtgaaaccccgtctctactaaatatacaaaaattagccgggcgtggtggcacatgcgtgtaatcccagctactcaggaggctgaggcagaagaatcgcttgaacccagaaggcggaggttgcagtgagctgagatcacaccactgcactccagcctgggagacaaagcgagactccatcttaaaaaaaattaaaaattaaaatagcttttggaatcttaggatttcagataagaggttgtggacctgtttttattatgtttttgggaatatggcaataaataagattgtctaatgggatatagaagcaaataatgtagttgccataaaatatgttaatagctataatagggaaaatgcaaagtgcatcacggggggcatggtacctgaagggatttggggagtgcagaagacttaatggggaatgtaacgtgggaattggttagttgagctttccatctagagtgtgaacagcagatgcaaagacttgataaacttggcgtggcttattggatgggatgaaaattgtccagtctgactagaattgatgtaagatgggaatggcaggagtttctgatcatgcagttctaataggccttgtgagagagactgaggcattggatgagccattgtagggttttgaacagataataccatctagaaagagcactgtggccacagtgtggaatgtattgcagtggagtaagatcccagagagtgttaaaatgatctatagacataagatcattgtgacctgtactggagaactggcagtgagggagatacaagtggacagatagatatatggtgctttttataagaagtggaatcagtggatttggtgatgggatattcagagaaggaggggacagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcctggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggttgcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcctggcgagagagcgagactgtctcaaaaaagaaagaaagtgttcatcttccttacagtgagccggtgtgattggaatgtcatagtcatagtcactgttgaacaatgttaatacttatactcaatgggtgagttttcttttctagtaaaataattctctgaatgctaagtaaaagtgataaaattacaaatcaaaatttttctgatcataaaaattatagacaagatattttgtataactacttgttttattcatgaagcccttgccatcttaattttttcctcatatttttctccctctctttcttctccccttcactcctttttgttgtaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaaatttgaatgctccattctt

SEQ ID NO: 888 - DNA, 145307 bp, mus musculus
cgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaaatattagcatgtgcgagtttggtagtgatcaggtcttcagattcttgtgacgtgaggcttagggttggataaatggctgatttttcattcattgtgaaataagttaaagagttatacagcaggtgtgtagatggcttcttaaattatttgtgtggatttctgtagcgactagaacttacacgagaatttgcaaaatttctagtagaacctgcttaaattaagcatgttattttttggaagttccatagttacaacgttaattgaatttacacggtgcagtttacaggtgtatataattgcttcagattgtcttttagtttaaataagcaagttgtaggtatagattaaatattcatgctttatttttcggggagagaagtatgtgtactgttcttttacctggaaacccatgagtccctaaatctacttaacgtttgtatactttcacttttgaggaagaatgatttggggtgcattgattaggaaactttccagcaggtacttaaccctctcggagctgattacccttaggtaaggactccttaaccatgactagcttggctggttagtacacttgaactcaaaaatagagactataaactctcctttagatctcgctcgtcttctaattcgctgggctgccattttggtttcagcaaataccttcaaattcttgaagaattatgtattaaatataaaaaagtgtcaacattcgttttctcaatttttaaactcatgtgctgtgtcatacatctaactttaaccctttaaactttatcgttccagcttttgggtggagtgaaagcttgaagtatttggaattggtgttccacaggtgaactcaaaatgtctttggtattttactgttttattttctctaatttaaaaataggacgtttggactatatgaattctctctaccccttttcttgtatttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattttccatttattgccttacgatgggtctgaggtctgtcaggttcaaccagtggtgcttcgactactgtgctatgttagtgaaatgacactgattgctatttttaaaaaagcatttagagcttttggtttgtttctcgtaccagagtaagttaagatatagtttagtttttaagactatcaagatagtctccaatttgataaatatcttggttgcccaagggagatgttaaaagctatgtggcaaataggtttctccccttccatatatcttccagcgtgctcagggtgatagtttagttggtgcgtttatgacaaaatattacacaacattcctaaaaggtgtagaaactatgcatttgtctcctagtaatttatttaaatgatcccacaaattaccgtttagtgtcacatgaaattctgttatctcagtttgagaatttagagttttatttgtcttagtcaaaatcagtttgattttgattaagcgttttgaattttgtgttgttttgggattgatgtataattgttttatggaacgaatgaaataacaataacagacatttatttggagtttctgtctcttaatccccttggtccattggaccaaattctgcatggtgggggcatggcagcagggaagcctataggagtttaggatctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttctgatgctgttaatttttgaccagaaattacatactctggtgtcaccccttactcctgccattcctttgctgtattgatgctctattatctctatacagtgtgtttttctatttaatttactttgtttaggtgttttgattaattttgtcctcacaattctatctttaaggttagtggctttcattctaagtcagtgataatatccttagcacctagaaagtgcctggcatatagacatttagtaactgttggatgaatatagtttatcacattcttgctattttacttattttttgctaaatctttttacttctgggagtcacttttcttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaacttgcagtacctccaacctcttgtacagaattgattcatcttcattttatggcaccctacagtttattcttattaatcatgtgagctttgaacaccatgttagtcaaccataatcaaaggaattgttttccttgggatgagtttgagctggtgatcgtgcatattagatcccatcttctacagagcctgtgaattgggtggaaaggaaaaagggagtggcgaagcctcctgttagtatccttgatgtccattttattcctgctgactttggtggctattgagagttataagttgaggctgttggttacatctctcatttctagtcttttctgttaactggttacttagaactcctaagtaaggccgctcattattaacttggaccccagagagcatggaagttaccgtatagtattgaacccatttctgcctaacagtgttttctctctggtcgaggtgtagtgtacaaagttttggttgctctgcttggtaacatctctggagttcagagcacagggatcagtaaactttttctgtaaagggccacatagtaaatactttggactttgtgggctaagaggcaaaattgaggacattgggtaaaatttttattggtgaaataaaaaatataattaaatacagttatgtataacttaggtctaatgagaaaaacaatttggtgtgtgtgtgtggaggggaggtaatacagtattttgctttattgggtaaagttcagtgttccctgtcatcaaattgattgcagacgttctgtgtgaaatccattcttaccttgtgagctgtacaaaaacaggaggctggaattggtctgttaccatagtttgccagcccctagttaagagcagtgatttttttttttaagaggaggggtctcgctgtcactcaggctggattgtggtgacgcaatcatagctcattgtagcctggaattcctgggttcaaggcatcctcgcacctcagcctgccgagtaagtaggaccacaggccgacatcacctcacctggttaatttttgttagagaacaggggtttgactgtgtttcccaggctggtctcaaactcctggcctcaagcaatcctcctgttttggcctcccagtgttgctgggattataggcctgagccactgtgcttgacctcctatttgatacactatatgttaacaactctgaacctcctttccttaagtcaggttcaaacttctgtacattagctgatgaaagggatttctttttattgcaaggtggtattgcctgagaatagtttggtttcagcagctttgctgtatttgtacggcagtatcttgtgtttatgtgcaagttcagatgtattttgcctttttataagaatgagcagaaaacaaaaaagtaaatggcgcgatctcggctcaccacaacctccgcctcctgggttcaagtgattctcctgcctcggcctcctgagtagctgggattacaggcatgcgccaccacacccagctaattttgtatttttaatagagttggggtttctccatgttggtcaggctgtcttgaactcccgacctcaggtgatccgcctgcctcggcttcccaaagtgctgggattacaggcatgagccatcatgcctggcctacctggaggtcttaaatatccttgagacagagggaactggttagggatatgaatcttaaaccttactggattaggttgtgctcattggttaggttagttggctttgtgcaaatagtgaatgcaataattagaatgaaataggaattaagtgaggcaaatgtatgatgaagtttacatttgaaaggtgagggtataattagaaataaaagtttctgtactctgtgagtgggaaaaacccctaaaaaggtgactgtcgtttttgaaatttttgacttctctcacattttcgggaatgtgaaaggaggatactggctatgtacagcatttgtccagacttttgaaaatatagaaaatctcatttactcatttaattagtgtgtatattatctgtttactgtgtcctttgtagatataattaattatccaggattcttaagagttgacttggagcatgctgagctgaggcaagagggattgtggggccagactgagtgttggaggaggaacctactgtagtgactacaggtgtatttcttttttctttttttttgaaatggagtttcactcttgttgcccaggctacagtacaatggcgtgatctcggctcactgcaacctccgcctcctgggttcaagtgattctccagcctcaacctcctgagtagctgggattacaggtgggtgccactatacccggctaattttgtatttttagtagagatggggtttcaccatgttggccaggctggtctcgaactcctgacctcaggtgatccacctgcctcatcctcccagagtgctgggattacaggtgtgagccaccgtgcctggtgtgtttcttgtctgatgtcagtgcatgtcgttatctgagccatatcaatgtcagctgaggattgctttgttatcctcggtgcattatgggaaggagaatcatgtcagtgctaccttactgtgattgaattgaattcattgatttaatatagattcagttagtacgccttatccataatatttgggatcagaagtgtttccgattttgtaattttttccccatattttggaatatttggaatattacttgcgggtgagtgaaaattcaaaatccgaaatttggggccaggcgcggtggctcacccctgtaatcccagcactttgggaggctgaggcgggcagatcacttgaggtcaggagttcgagaccagcctggccaacatggtgagacccccgtctctactaaaaatatgaaaattagccaggcatggtggtgtgcacctgtaatcccagctactcaggaggctgaggctggagaatcccttgaacccaggaggtggaggttgcagtgagcccagatcgcggtactgcactccgtctagcctgggtgacagagcgagactccgtctcaaaaaaaaaaaaaaaagttcagattttggagcattttggattccagatttttcagataagggatgctcaacctgtgccattttaggcaccagagggtatataaagatgattctctgctttcaaggctctgaagtatggtgaaccagacagttatacagtgcaattacagctgtattaagtggaggtgtgaaaagtgtagtaggagagatggagaaatcattgtttggcattgggtgaggtcttcaaagatgtcctattttcatggccctattaattagagcagggacttccggtcagagggatcaacttgagatcaggcagggttttttaaccctattgacagtttggggcagataagtctttgttgtgaggtgctgtcctactcagccctggcttctacccacaagatgccagtggtatagcccctaccccactcatatgtcttcagacattgccagttgtgccctgggggcaaaattgagaaccattatttgaaatggagcaatgcaagtgtgaaagtatagtgttttcagagtaagaactagtaggagagtgtgcaaggaacactagagatactgggaggggaggggttatgggagatggaactgaaaggtagtttgagtgaagctaaaatcacaaggggtaaccttgagtgccatgttaggacatttgccttttactgttaaggtaatgagagatgtactttgaagtttaagtgaaaggagacattagatttgtgtttgtttttgaaagataattctgatggcattcgtggcagatgtgttggagagttgagtgtcgggggattgagatggtattttaaccgttcttctgaaagataagaaataatgattagggaatggaataaaggaaggagatcaatggggtgctcccatggtatgagggaggtgctgctaatttgagtttggcttttctgccacagaatggagtactgagctaaaaagcaaaacacctctattgtcttcctttcaacttttcctgccacctccaattccctttcctcactgagagctgctgtctgttgaggtctgttgaaaggtcattgagagaagggaatctgggttacagaatgactactctctcaatgtggttccttaaacagtggattatcaaagcacaagtgtcatcttcccccccgctccccgcaaggggttagactggcatccagagagcattaattgtagcctctccttggtttgtgtagatgttattttgccctaaaatactttgatatacaaacataggtgaataatctgatggtttaattgtaattatttcattgcttcctattttggaggttagctttactattttaagtgagaatgtagtcagtggaagggtactggacttggagtcacaagatctgtgttttatttttttattttattgattttttgagacagagtctcgctctgccgcccaggctggagtgtagtggtgtgatctcagctcagtgcaacgtctgcctcctgggtttaagtgattctgctgcctctgcctctcaagtagcttaggattacaggcaccaccacccacggcgaatttttgtattttttgtagagatgggattttactatgttggccaggctggtctcaaactcctgacctcagctgatcagcctgccttggtcccccaaagtggtggaattacaggcatgagccaccgcgcctggtcaagagctgtgctttagttccagttacccaactccctgtgttaaatcacttagctaacctcttgggtcttcatgactctgtaaaaccaagatgttgggcaagaggtgagttaaactactacttttttaagttcttaaattttatctttattcctaaagatgtggaaaaatctgtagtcaagagaaattgtcaagtaaaggaaaacagagaaggtaaacactttaatgggtttagaagttggttatattcctccatttacttgtcaatccaacaacttgaatgtctcctctcccttgtttctcctgtgtggtctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaatgaaaacagacatttaataaagttatgtatgcttttaaaagtaacaaaaccccactgcatgtcaattagatatttttatgaaaaataacttttccagaacaaaaattagaagagaggcattgttttacatgttttacaaatctcctatctggcttaatagaagacaactggattctctgcctccttctgccttcaatctattgcgatataatacgtcatatagcctttggaagaactccatagtacacttgagaaagaatgacagtgaaaatggcaagtaaagtcttaagaaaacaattttgacctctctgacctcttgaaaagatctcagggatctttgagaaccagtgtcttagactgccaagagaagatgtgatgttatcttttgagtggcttatctactgtaaattttattttaactgagatatataacttacagtaaaatgcacaaatatgagattgtatagcttgataaatttttagaaaatatatacatctgtgtagtcattcagatcaagatacagaatatttccagcaccctggaaggttcccttatgcctctacctcctccctgtaaaaccccaaataccctgacctcttttttttttttttttcttgagatggagtctcgctctgttgcccaggctggagtgcagtggtgtgatcttggctcactgcagcctccatctcctgggttcaagcgattctcctgcctcagcctcccgagtagctggaattacaggcacacaccaccacacctggctaattttgtatttttagtagagatggagtttggccatgttggccaggctggtctcgaactgctgacctcaagtgatctgtccacctcggcctcccaaagtgcagggattacaggcgtgagccaccgtgcccagcctgacctctgtcttttaatgaatgttatgcctatttttgaacttcggataaatggagtaatacactatatactcctgtatctggctgctgttgctcaatacatgatcactaactgtctttttctttattgtttttttgagatggagtcttgctctgttgcccaggctggagtgcagtggcgagcttggctaactgcaacgtccgcctcccaggttcaagtgattctcttgtttcagcctcccgagtagctgggattacaggcgcctgccaccacacccggctaatttttgtgtttttagtagagatggggtttcgccacattggccaggctggtctcgaactgctgactgcctgcctcagcctcccaaagtgctgggattacaggtgtgagccaccgtgcccagccaacttcgtctttttcattactgtatagtattgtattaaatccatgatttatttatccattctgttggattgaggtgggtttttttcatttgtttgttttgaaacagggtcttgctctatcactcaggctggagtgcagtggtgtgatcacagctcagtgcagccttgtccttccaggctctagcgattcctcccacctctgcctcttgagtagctgggaccacgaccacatgccataatgcccagataattgttttttttttttttttttttttttttaaacagagatggagtctcactatgttgctcaggctggtctcgagctcctgggctccagcaatcctcctgcctcagcctcccagagtgctgggattacaggtgtgagccactgtgtctggctgacgtttgagattgttcagtgttttcaccaatataaagaatgttgccatgaacacttttgtatatgtcttttggtggtcttttgctgcatatccaggattggaattgctggtttataggatacatatgtgtttagctttagtcaatactgccaaacagatttcccaagtagttgtaccagtttaaactcctactagcagtaggtcgtgttgctcttccttatcaatacttagtattattatcagtcagtgtttctaattttagccctcttggtggaagtttaggaatatctggtggcttaaatttgtatttgtgtctagtgtttagaatactttcacatgctcaccagtcattttactatttaactcttgcttacctataaaatttgaagcttggctaataacatcttgtgtagttcaaaatcactagttgaatgaattttctgaaatgaggcttttaaaaataaacttaattggctggtcatggtggctcacacctgtaatcccagcactttgggaggccaaggcaggtggatcacgaggtcaggagatcgagaccatcctgaccaacataatgaaaccctgttgctactaaaaatacaaaaattagctaggcttggtggcatatgcttgtaatcccttttctgagaagtctttaatagatactctctaccctcttctaatttactccctttccaagctttttattaaggaaaaatcaaacatacacagatgtagataaacttccatttgcccatcaatcagcttcaactcatggctagtcttttttacctacccccttccattttgatgcaaaacccagacagcatttcatcttacatatttcagtatatcccattctaatttagatgtttttttccttggtgctcatattgtgctgctctattgtaaattataagttcaatttagttcttacatattctctcattctgctttgtaaacttctcacaggtaacaatcactaacacttaacacctgtgtgtgaggatctatgaaattgcttcacctgcataaattctttatattcttacaacagctctaaaaggtagatattactgtctctgttgtatatataaggaaaccaaggcacagaggttgaataacttgtccagcttgtacacctagttaagtggtagaacaggaattcaaactaaggcagtttatcttcagtctttagtgttaactactgcattacataatgtctgagtaaatgagcgctctactgcatataagttccttcaatcgtcctttttaattagcattttttccttgttaattttgcctcctgtcttgcatttccaacggcacacaagtattatttgctctttcataaaatctagctaaaagggcccttagcatgcaactctcttattttttatttatttaaaaaaaattttttttgaaatggagttttgctcttgtcacctgagctggagtgcaatggcgtgatctcagctcactgcaacctctgcctcctgggttcaagcaattctcctacctcagcctcctcagtagctgggattactggtgcccaccaccacgcccagctaatttttgtatttttagtagagatggggtttcaccatgttggccaggcaggtctcgaactcctgacctcaggtgatccacccgcctcagcctcccaaagtgctgggattgcagatgtggccacctctcctgttttaaagatgatcatcccttgcttttagctgttctgcttctaattttatatgtgatattctatcaaaaaattgctgacctctggtctttttgtttaataatagtgtctctataattatggggagaaggtaccacatactgaatttaaatattttcgtcttttatatactatattttaaatttttaatgtttttatttttgctttaacattgtatttgaaaatttcatttgcagtaactcgatacagctttcactttagatttttctgttttgagtattagcccttccggtgttaatttgagtgttcgaatctttaggattaattgtgcaaagatataaagactttagagaagccagccaggcacggtggctcacacctgtaatttcagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactattacagaaacaacccaaatgtccattgtccatcaagtgatgaatgcataaataaaatatacaatggaatattatctgtcaatgaaaagaaatgaagtactgatacatgctacaacttggatgaactttgaaaatgttatgcttaagtgaaataaaccagtcacaaaagacctcatatcacatgatgccatttatatgaaaatagattagcatgggactgaggggaggttggagggaagggagaatgctattaatggtatgaagtttctttttgggggtgatgaaaaagtaatctgagatcgattttggtgataattgtgcaactctgaatatactgagaacctttgacttgtacactttaaatggacgatttgtatggtatgtgaattagatctcaagggtgttattttaaaaaacttaaatataatttataatgataatctcattgattaaacataatttgaaattttttggtgtactttttcagattctttacatttatgatttaaccaatctggttttggaagatacaggcagaaagaacacccagtggaggcacataaaaaatgttactagactgggtgcagtggctcatgcctgtaatcccagcactttgggaggtggaggtgggcggatcacttgaggtcaggagttcaagaccagcctggccaacatagggaaaacctgtctctactaaaaatacaaaaaattaattagctgagtgtggtggcacacacctgtaatcccagcaacttgagagggtgaggcacgagaattgcttgagcccaggaggtggaggttgcagtgagttgagatcacgccgctggactcaagtctgggcgacagaacgagactgtctcaaaaaaaagaaaaagttaattattaatactgccttgtctaaaatgtcataaatgaaatgagatctttcttttcagtgtattgggttagcatttcatgattgggttagtaacttagaaaagttagataattttgtcaaaaattggtaaaaagctgttaacagataactttgagtttatcttttttttttttgagacggagtcttgctctctcacccaggctggagtgcagtggtgcaatcttggctcactgcaacctccacctcctgggttcaaacaatctccctgcttcaacttccctagtagctgggattataggcgcccgccaccacgcccggctaattgttgtattttttagtagagacagggtttcgccatattggccaggctagtcttgaactcctgacctcaggtgatccgcctgccttggcctcccaaagtgctgggattacaggcttgagccaccacgcccggcctaactttgagtttatcttaacctgttgtttcaacagagtagattgatagttaggcatacccgcattctgtaacatttgatgtgacttatgtctaatattaagtcaacattgctcacctattggctgatttagggactgggatttgtcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaattttcttcagagccagcacaaaatctgataggaatattatgctatgaattgtcttctagaaggtaagataccacccccactcccccttttttgagacaggttctcgctctgtcacccaggctgaagtgcagtggcgtgatcatggctcactatagccttgaactcccaggcttaagccatcctcctgtctcagcactcccagtagttgggactacaggtgcatgctaccacgctgagctaatttttgtattttttgtagagaaggattttgccatattgcccaggctggtgtgctgggcaattcctgggctcaagtgatctgcccacctcggcctcccaaagtgttgggattacaggtgtgagccacttcacacggcctatacctttaacttgaaatttactttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaaaaaagatacctggagttagaacatcatctgttgtcggcctgtctgctatgttgcagtatatgcattgttgaaaacctcatagtctgcaaaaatcaggtaccaaaaactaacaatgtgtatagggaaaaatgggcttaagagtaaactgatcacttcaaagctatgttactttgtaattagagcactaacaaaacaataaaaattccagtaaaatagcacagttttgaagatcctaaatttctgacaaactacaataaatataggacttgaaaaaggtagcttgatggaaggggcaggtataagggggagggttggggtgactgacttagagagacaaagctaagatgcataaatatcaggtggaactgcgtacatacttctgagacagagcatgtggcctgactaagccaagaagaataatgtggggctaggaggtggtggtgatgagcatctggttcagacctataacccccaaccccatgctgcattcagcttctgttacttgtgggtacaaaacatcaatgtgttgggggaaaagtggcaaccactattctactttgtgaatttgacgactccaggtacctcataagtggaatcataaaatatttgtccttttgtgaccgctttatttcagttaacatagtgccctcaaggttcatccatattgtagcatgtcaaaatttccttgctttctaaagctggattattttccattgtttgtatgtatattttattgacacattcatctgtcaaacggatacatatgcttccacattttggctattgtgactaatgccgctatgaacatgggtgtacaagtatttgttcaagtccctttcagttcttttgagtgtatacccagaagtggaattgctgtatgtatcatatgtaaattctgtgtttaactttttgaggaatcaccatatgttttccacagtggctgcaccattttacatttcttccagcaatgcacaggggttccagtttctccccttatccttgctatcacttgtgttttctgcctttttgattatagccatcctagtgatatctcatagtggttttggtttgcatttccctgatggctaataatgttgagtatcttttcatatgcttattgaccatttgtatgtcttacacattcagatcctttgcccatttttcaattgagttgtctttttattattattgagttgtatgaattctttgtatattctagatacaagtcccttactggatacattatttgtaaatgtttttcttgtaatttgtgggctgtgggttgtcttctcactgtttacagtgttcttcggagcacagaaattttaaaattttgataaagtcccatttaactatttcttttgttgctcctgcttttggtattgtatctgttagaatccattgccaaatcctaggtcattaagatttaccctcatgtttcattctaagagttctatagtttttttatcttatatttaggtctttgatgcatttcatgttaattcatgttgttactgggaaacacttctatatgtagtaggctcaacaatgaattatacacatgttgtgttacacaatgcattttaagtcagttaagagaaagaaatatgcagtcatactgttttcttataattgcataattgtatttaccagtgttatttcactgagtttgtgtcttgtcatgctcctccggttgtcatactggaagtatatttctgaattaatttttttttttttttttttttttttttagacagagtcttgctctgtcactcaggctggagtgcaatggcgcgatcttggctcactgcaacctccacctcctgggttcaagcacttctcctgcctcaacctccaagtagctgagattacaggtgcctgccaccacgcccagctacttttttgtatttttagtagagatggggttttgccatgttggctaggctggtctcaaattcctgacctcaggtgatccaccagtctcggcctcccaaagtgctgggattacaggcgtgagccactgcacccggccctgaattcatttttgaaataaatttggttgatagttttctttctttcttttcttttctttttttttttttttttgagacagagtcttgttctgttgcccaggctggagtgcagtggtgtgatctcggctcactgcaacctctgccgcctgggttcaagtgattctcctgcctcagcctcccaagcagctgagattacaggcgcccgccaccatgcctggttaagttttgtatttttagtagagatgggtttcacaatgttggccaggctggtcttgaactcctgacctcgtgatccacccgccctggcctcccaaagtgctgggattacagacgtgagccactgcgcctggccaatttttgtatttttagtaaggatgaggtttcaccatgttgaccaggctggtctcgaacttctgacctcaggtgagccacctgccttggcctcccaaagtgctgggattacaggcgtgagccactgcgcttggcacgatagttttatttctttcagtgcttgaagaatgccatcccactgccttctggccttcaagttttctggtgagaaatcagctgttggtcttactgatgatcctttgtatgtggtgatggatgcactttttgctgcattcaagattgtctttgtatttggcttttgacagttgatgatgtttctcagtctggatcttgaatttatcctacttggaatttgtcgaacttcctgcgtgtgtagattaatggttttcattaaatttggaggcagtttttgattctgatttcttcaaatgtcttttctgttcccttttctcccgtttctggggctctcattatgcatatgttggtttgcttattttgtcacacatttctctgaggctctgttcattttttttctctgttattcagattgcttaatctaacagtctgtatctttgctgattctttgttccgacagctcattggctgaatttttcgtttcagttattgtacttttcaacaccagaatttccgtttggttctttttgttgttaaattctgttagtctctgtttgtttagaaattgtcatattttacttctttaagcatggtttcctttagttcattgaacataagcataagagctgtttttgaggtctctgctaagtctggaccttctcaaagtcagtttcttttgcctactttttttctgtatgtggggcacacattcttctgtgcatgtcttaaatttttttgtttaaaactggaccttttatataatatagcaactttggataccctacacctctagcagctttgttgtttgttgcttccttatttatgtagtgactggctgaactattttagtgcctacccctcagcctgtgatgttgctcttcagcgggtgtagccttagtcatgcctgggatgatggtgattttagcaaggctttgtgagtttctgtgatctctctgttaaacctctctctgtgttggtatcacatgcacatattagcctctactaattgcctactgattggtctgttgatttaaatgactccttgggacataaattgccccacagtctgatccagttaaattctcatgctttccaggggtaagtaatctttgaggctgtgtctgaggtttgttctgaccccaggaaggttcttagcttttatttccctggttctatctggtaagctgctagctgagtagtttaacttgttgctgtccaccacaggtcttttgatagctgcttattaccatgatctctcctgttttgtgttgttttccaacacaccctcaggcagcatattaccatattgtttcaaatagttcactttaagacaacttcagaactctgttcttacggcctgcctttccccctgggcaaaatctttacaccactgcttcagaactgggttggactgtggctcacttctcagagtgacacctctgcttcttgagcagggtgattggctttgcctgccatggaatcttgactctgagtgaggtggggtgggggccattaggaccacgcttttcttgacttgctgcacctggggttaagagcgtctgcctcacaagtggggcctagctggaaaaaagagccccagacttcttagccactcttggtgcaatagagcctgtgcaactcaaagttgggggtgttgagaaatgctgcctgcctttacctcctggggagataccatcaactgggagctgggtcgggggaggtgtgttcttggccgttctcacctggagtggagctactgtcctgctgagctggctcaaatgccacagactatccttactgagatatggtagattttcttaaataaattattttttcatttggtatatgcccttaggacaatttccagaggcttttagtgttttttgttttttaaaaaaataattttcaccagttaacgattgtttcactggggagagcatttacggagcctttgagggcaccattccaaaagttatttttaatgtaaaattactcaaattgcctacagccacttaaaaatttgtgtttgagaatgctttggaaaagatgctgaagtttatatgtatgtaaaagcttcattactctaattgtgtacgtacaacttgacagatgctcgatatggaggaggtttgaataagggtgtttggccaattactgagcatttctaaaagaatacatttctgctgccacaaagaattttgaatgcaggatgcagttctgttgcagtgacttataggaagtagccatggatgtacacagtaatttagtgacaaaaatcaggaatctgtaaggggtgtgtatgtgtgtgtgaatagtgttggaaataaaatacgagcatttagctcaagtaacatatttgaatttaacaaagattaattggacatctttatttgcattaacctgaattattgattggatttaaagctgtctagaagtagcatcacactggggatggggggggcaggaaacctgtgcttaatacagttatcttgactggctttgggtataatttatcataatgtgtgataagaatgataaagtctgtgcaaatgataatggcagtgctggtggaactaggaaaagaaaagcttttacctttgagcaaaggccacattttaaaataacttagggatgtttaggtgtatagctgtgggctcaactattaaaaataacttactgtatttcagactccttaacatgaacctcctcatttaacacactctgtcagagggagagatccccagacttctcagccactcctgcctgtttgagaaggattctcaaacaccccctcccccagagaaggggcctcattttgttgcccaggctggcctcaaactcctgggctcaagtgatcttcctgtctcagcctccggagtagctggggctataggtgtgcaccaccacagccagctaatttttataacatgattttttattccatatatctgaggaatacagctaattgtgtcttagttccttgatatgtactataacagtgacaacgatacttaacatgcagaaattgtgaattaagtgaaaaatccaattttgtaaaacatgtttctgcatcaaaaactaaacagtttgtcttgggagtggggttatggtgagattaatggtagtttccccctcccttttctgacattattgatgtatggtgtgatagttaaaactgtaggacactggcacttgtactgtctgagtttgaatcctggctcctaccactttgacagcctgtagtcctctgtcccagtttttttactcatgaaattgggctgataatagggttgttctaaggattaacttgcttagaatagtgcctgagacaaatacttaaatgttagctattgtcactattaatgaggaaaatgttatttaaaatttgaggtgtgtcaacctggctgcactagtattgaagttgggaaatgagagacaaagttggaaaaataagttaaaggctgattatgaatgaccttgaatatgtaccagatggagaagagaagccattcaaggttttagagattgaaagtgttgagattaatttagcattaatatactgaacgattggtatggtagtgtggacgctagccaggatgctgttaaaataggagtctaggctagagtggtttgagtgggagtggaaaagataacattggacacatcatgaaagaagaatggaggagatgggaagggagagatttgactttgtttttactgtatttccccacactcccaattttagttttgagcactgctatagactgaacgtttgtctccacccctccacctcgcaaattcatatgttgaaacctaaccctcatgtgatgaggtggggcctttgggaggtgattgggtcacgagagtggaaccttcacaaatgggattagtgcccttgtattaataaaagagactccagggagttccctcactctttctgccttgtgaagatacagtaagaagattgctatctgtaaaccagaacgcaggccttcaccagacgctaaatatgcttggcaccttgatcttagactccccagcctccagaactgttaagtgttacttgagccactcactctgagcttttgttacagaaggggctaagacaaacaaacacctgttgtttgccaatgaatccttgggattcagtgatgagcaaagcttgcatagcttctgcccttaaggagcttttatgttttagtaagaagataaactcacacaggtgctatgagaaaatagggtagctggctcctagagtctaggatgtgagtacttgatgaatcctgagtcaggagagttgggagctgctgaattaatatgggtaaaactaagcagactgctttgttcagaggctctcagaggtggcatgaaggagcactttgtgaaggaacaacaagaaggcaaattgaactggagtttgaacaagctttggctggggttagctgcaagatgaggctggaattgggtgtttgagggccttgtagaccattagataagtattttgatcttcatcctggtctttgaagattttttttttttttttttgagacggagtttcactcttgttgcccaggctggagtgcggtggcacaatcttggctcactgcaacctccacgtcccgggttcaagcagttctcctgcctcagcctccctagtagctgggactacaggcatgcaccaccatgcccggctaattttgtatttttagtagagatggggtttctccacgttggtcaggctggtctcgaactcccgacctcaggtgatctgcctgccttggcctcccaaagtgctgggattacaggcgtcagccactgcgcccagccagtctttgaagatttttaagcagtgctgtgacatattttgcatttcagtaaaactcatagtgatgatttttaataccgaaagaacaaaacaattgtaggaatggatgcaggcctgacagtcactgctttcaaaagaaagctcaatcccttttccctgttgtttccttttctccccgtttgaatttatagagaacaacagattctgtagagaaccttcatggtatagttggaagagccaagggttttagagtcttaacggaaattattgtgatcttgtataagctcagtgtacttaatctcttagcttctatttatgtctgttaaattggactgatggctgtatgagataggtattatgattaaatgagattatacaaataaagcacctactgttgtgcttgatacacaagtaagtacttaaaacttttcaagaataatatacaaactaagaactggaaaggagccacagagaacttttgaatggaatggaaccaacaagtccacaaaagaaaaaaaatctttagcataaatactgagacctgtttcgccttgcccacagggtggttatggaccatagtgtctaaatataattgattgtgaggtgtatgctacaagtaattataagcaattaaataattagttaaaatagtaatgtttgcaaatgagattacctaaaaatattagagtcaagattatccccttaataattattttcactcacatttcatgtgttttcgattgaggcaccaaaagaatccttgaagtccagcatataagctattaatgtttgctgtttttattttgtgctctgctttatacagtttttgttttttggcaatttctctgtgtccatagaagtgtgtcaaacctgtgataaccttattttagtgtcctttctcatgctgtggtagaaaaactgctgtgtaggttactttttcttctagacaacaatgcactaaaattttgtctttaaaaacataattgaatctgtcatagcaacagcatgttcaatttaaaaattcaaaaagatctaaacttggcttaaaaatacgtttttttgttgttgtttttatttgagatggagtctcgctctgtcgcccgggctggagtgtagtggtgcgatcttgctctctgcaagctctgcctcctgggttcacaccattctcctgcctcagcctcccgagtagctgggacttcaggcacctgccaccatgcccgactaattttttgtatttttagtagagacagggtttcaccgtgttagccaggatggtctccaactcccgatttgtgatctgcccgcctcggcctcccaaagtgctggggttacaggcatgagccaccgcgcctggccaaaaataagtatttttgtactctaaaatggtgggcattttgaaagaaagcttagctgaaaagatgctgcttactggattgtaataaacatgaaacaattgatttatacattcacattataattttaaatcagtatatagttgacccttgaacaacatgggttcaaactgtgtggtccactttcactgcagatttttttcaataaatatattggaaaatattttggagatttgtgacaatttgaaaaaaacaggataaactgcatagcttggaaatactgaaaaaattaagaaaggtgtgtcatgaacgcgtaaaatacatgtagataataatctatttactaccataaaatatacataaatctattataaatttaacatttatcaaaacttaatgcacacaaacgtttttatagaccacatgtggtgccacgtgcagttgagagaaatgtgaacaaatgtaaagatggattaagtcataactgcataaaattaactagtacattctctactactgtaatttcatagccatctccttttgctactgcgatgagtttgttgtaagtatccgatgaaaatatgtgacgctgatctctgcatgagcagttcatctctccagtaaatggtctatcatagtaaaaaatgatctctcatgttctcatgtatttttcatcatgtttagtgcaataccataaaccttgaataacattacgggactcatgaagtgtcactagtggtgctggcgaacaggctcccaagaagcagagaaaagtcatgacgttataatgttctgcaaagtttcttataagaaaaagttgaattgcttgataggtaccatagattgaggtctgaggtctgcagctgtggttgtccgccatttcagatgattgatcttgtaaacagatgatgtaattttactttattggtaaaaacagtacagtactataaatacattttctgattttcttctttccttttttttcccttttcttttttttttttttgagactatctcactctgtcacccaggctagagtgcagtggtgcgatcttagctcgctgcaacctccacctcccgagttcaagcgattctctgcctcagcctccctagtagctgggattaaaggtgcacaccatcacacctggctaattttttttgcattttttattagagacggggttttaccatgttggccaggccggtctcaaactcctgacttcaagtgatccgcccgcctcagcctcccaaagtgctgggattacaggtgtgtgagtcaccaccccttctgagtttctttttttctctagcttgctttattgtaagaatacagtattataatacatgtaacaaaatatgttagtcgcctctttatgatcagtaaggcttcttgtcatcagtatgctgttagtagttaagtttctgaggaatcaaaagttatttatgggccgggcgcagtggcttatgcctgtaatcccaacactttgagaggccgaggcgggtggatcacgaggtcaggagttttagaccagcctggccaacatagtgaaaacccatctctactaaaaatacaaaaattagcccggcattgtggcacctgcctgtagtcccagctgcttgggaggctaaggcaggagaatcacttgaaaccaggaggcagaggttgcagtgagccgagattgtgccactgcactctagcctgggcaacagagcaagactccgtctccaaaaaaaaaaaaaagaaaaagaaaaaaaaaaaaagtagtgaggtctggcgccctctactggtgaaggctaagtatagcttgtgttgtacagttaggtctcttgtctctagtgagtcaaatattttaatggaaaaacaagggttatagatgtcggttaaacatagaaatttgaaaggaagagaagtaattccctttgattgttggtgcataaaaccggaataggcaaaattcacaagtcaagattaatttccaagtcaagataatttccatgtttgagcttaaggatgatctatcaaattgttttctaagaaactcatttcactttgatgtccagtaaaggaaataatctggtagggggttggagttgctgttgcttgtttattgtctctatccccagtctgtaatgttccacaaaagcagagatatttgatgcactgtgtacttccatatattctcctatgattagaacaatatgtgacccattgcagatgctcagtacacaatttttgaatgactaagctttgagtttttatttaaacaccttttttttggatgaaaagaaaaattgagagaagaaaatcttaagtatcctaggatcatatgtagaatcagaggatttcaacgtgctgtataaaaggagagagattctggaacatagggcaaattttagcagagttgggataatgactgggtaagaaaggataattctttgttctaaaagggatttctctggtattaaggccctgtgtgaaagctgctggagaaattcagttctgcaaagtttaaagtaaatggtttgctgtttatggagtactagattacttaatgcagtccagcctttatctaggtaaaggtgatgcttttcccattgtggaagatgttaggatgctaagtttgaatatgaaaatgtgttgtgtgttgtagaggcaatcaaatcaccattttggttgtatttcccattgagaaaattaaagatgcttctgtttgtgtaataattttgtttttatgaaataaagcgtaaaacttcatgtggtaaaatttcacactgtgattcattgtatttgagcatgcctatggaaagtgattgttactgtgtcaaatattgaatgatttgaataattactaagttgttcagttgtgtgtaggatactgctgctttgacttggtagagagcttgttctagccctgctaggtatgcctaaatctctgtgacataaaaaacaggctcttttagagttgtgagactgctacttgaaatcaggcaaagctgtgtgattcccagctgtttccaccacttgagtattgaataggatttattaagaaaagtagtggtgttattcttggataacttagttgtatctgtgataagtttttttctcccactcaaacctttccaaattatatctgaaggcaatattttcagattcattcctgaaatatttaggaactctgcacagtacattgtagaaagggaaaagaaaatttacatttttttgagaattactgtgcttgctatttgtgagactccttttattaaagcaattctcatggctttcttttttttgtgtgggtaatagcatctcaattttaaatacctggaaaaagaatgagagaggttgttactttctttttaagataggcagattgtaagtgacagaagttggattttgaatgagttatgtttgaatccagaaattatttttaattgctccatgcctatttcctgctctttatcttgcatcttagtgtgctgagggaaagggatcaaattcttatgtggtagtagagagatgcagcagagtatgctatgctgagacctgacatacctgctcagcaataccggaaatatagaaatgaggacagcttgtcgggtagaagaaacagaaaccaagagctagaaaggcgagactatataagagatagggatagcaagcagcttgaggcttttgctgattgagtgtcctgtcataagcagaagatgatttagttctgtggtcttagagaaaggtgttttgagagaggagtttcacactgccgcttttcccatttatcttagttattttgtttaaagggatagtcccttagttatccacatgatacttttgtctagaataatttataccatgacttttgccagatatttctgatttgtgtatagatggttactgaattcatatagatggaaggatattgtgcataaaaatatgagaatataattttgaggtattttagctcaaatgatctccaaatgctaaaagaactgcaaggtaagggaacagtgagtactctatatatacaattttactgtgggaaaatatacataaaatttaccattctaaccttttttttttcttcttcttttttttttttttttgagacggagttttgctctgttgcccaggctggagtgcagtggtgcgacctcggctcactgcaagctctgcctcctgggttcacgccattctcctgcctcagcctcccgagtagctgggactacaggcgcccgctattgtatgtttattagaggtggggtttcaccgtgttagccaggatggtctcaatctcctgacctcgtgatccgcacaccttggcctccagaagtgctgagattacaggcatgagccaccacgcccggcccttttttcttcttttttgagacggagtctcactctgtcatccaggctggagttcagtggcaccacctcggctcactgcaacctctgccttccggattcaagcgattctcctgccacagccttccgagtagctgggattacaggtgtgcgccaccacgcccagctaatttttgtatttttagcagagacaagtttcaccatgttggtcaggctggtcttgaactcctgatttcaggtgatccacctgcctcagcctcccaaagtgctgggattacaggcgtgaaacaccgtgctcggctgattttaaccatttttaagtttgcagttcagtggcattaagtacattcacattgtgggatgcttaccatcatccatttccagaacttctcttctttccaaactgaagcgctgtaccccttaagcaataactccccatccccccagcccctggcaaccatcattctactttctgtttctgcaagcgtgactaatctgggtacccgtgtacttggaattatgcagtattgttcttttgtgaatgacttatttcacttagcatgatgtcctcaaggttcacccatatcgtagcacctgtcagaatttcctttctttttaaaaaatactaaataatccactgaacataggtaccacattttgttcgtccttgtattgcttcctggaaagacttttaaaagagacacagtattggcttagtagacaaggtgatctccctggccccctacttgccccacacttgggaatatatagtcgctaacctcatcactctcaggaggagatggtagggagtggaggttgtatttattttcgggaaaaaaaacagactcccaggtggtgctgatgaatccatctcttcctacccttttgtgaatagttgaatctgtgttcaagattcccaagttttgcctgaattctagacgtgtagagccaactctctagtggttttcacctcagtttcaatgttaagaactgtacgaactgccactctacccctttccttggaagagaagtggacgggaaacctggagtccaggattatataagccaaggaagctcagagtttcaagaagggagaggtggtcagtgtctaatgatgagaagagggcaaacaggatgaatattgagaagcagttatttgatttgtcagtaagtagaacattgatctgtggaccttcttctcatgcgtcccctaatgcacatactcaaaagctttgtatgtaatttttaggggaattaatcttgaagcccatccctacgtctcgattaagaccttctggcttaaagcagttttagttttagtagctttggatggagccaggtgatgagagagaatggacaaagtggaaggtgagatgggcggggcatggtggctcacatctgtaatcctagcactttgggaggccagggaggagaattgcttgagcccaggatctcgtgaccagcctgggtctcaaaacaacaacaacaaaaaacccaaaatttacaacttacctactttgtcttcatcacatttatttaaaaagaaagagaagggggaaatggagacagtcttacgacttgtgggaaaagggaagggcagacactggtgattttcagtagggaagattcaagcacaggctgggaaaagattgattggggatgatgatgattggagcatcatcccttggagagggtatacaatgggatcatgaccccaagctgagggacaagaaaaagaagaaactggagcagatttgaagtagacaagaataaagttgaattggttagctaatattttgagtgccaagaaaataattattcacatattagccaggtgtggcagcacgagcctgtagtcccagctactcgggaggctgaggcaggagaattgcttgaacccgggaggcggaggttgcggtgagccaagattgcgccactgcactccagcctgggtgacagagcgagactccgtctcaaaaaagaaaataatcattcacataatttgtcagcagacccaaagtggctaaggaaaatgatatgcaagtttctcaaggttttgaaaattgtctgcttcacgtaacactctttgtaatttagggtgtataaaatggataacaaaagcgaaagagggactgcttaaatcagactttttcattttttttttccactttatgtatttaaagagcttctatgtctttagactcaccagtacttgatagtatcagtcttaaaactttgttttgcttcgccagtttgatcagtggaacaaattttggttttgtaatttgcattttcgcaattactaatgaggttgagaggcaggctagtgtagcatttaagagctatggactccctgggttggaatcccattttgccacttagtacttactgatacggtaatttacttttgctctctgtgcctccctttccttacctgtaaagagggatgatactagttcctactgtatacatttgtaaggattacggtgctacaaacagtgcctaacatgcgaaaagctctattttaaaattatgtcttatttcatgtatttattagtcacttctatttctttttgagaagtctatcttcatatctgtttttctacttctccctgaagcttctgaattttgcctagaggaggacatatcttttttgtgtgtgtgacagagtctcgctctgttgcccaggctgcagtacagtggtgccatctcggctcactgcaagctctgcctcccaggttcacgccattctcctgcctcagcctctccaggtagctgggactacaggtgcccgccaccacgcccggctaattttttgtatttttagtagagacggggtttcgccatgttagccaggatggtcttgatctcctgacctcatgatccgcccgcctcagcctcccaaagtgctgggattacaagcgtgagctaccgcgcccagccaacatatcttaacaaatcagtttttgtgtgtgctttagtcaagttttttttttttttttgagacagggtctcgctgtgttgcccaggctggagtgcagtggccccatttcatctcactgctacctccgcttcctgggttcaagtgattctcctgactcagcctcctcagtagctgggactacaggggtgagccaccatgcctggctaattttttttttttttgtatttttagtagagatggggtgtcaccacgttggccaggctggttttgaactcctgacctcaagtgattcgcttgcctttggcctcccaaagtgctagaattacaggcgtgagccactgcgcctgattttaaacatattcctctagcactttctatagttgtttacattttcctcattaatctgcctgtaatttgtgtgtatgtcaggtggtggcaggggttaaaatgtacgtcaacttttttttgacaatgatagagaacttgaagaggaagaagtcttagagtcagatgtgaattagagtccgctctgcataacttaggcaagcccctgctgtctcttatttttgactctgtaaaatggagataatactcaatttctgtgctgcatagactgggtatgagaatcaagtgagttgtggcagagcacttcgaaacttcctgcagtggcttggtaacctaagtggtgaaaaatacttgggtattaatattacagaagcaagcccccaggtaagttttatataccatggtatacatttggttttgaatgtcttaagccaggtcataattagaaaacttagaaatgaaactttgcaatgcttgtgggaagtctctctcaatctcttgagagccagtgagttagaaccaatcagttaagtttctctatctggtggcaccttagagtcattcactgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctggagttcggctatctcacagccaatctccaacggcccccagcttgaacctcctctccacctttagacacttcctctcttctctccttctctgctgtgcttctctgccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatctgtaatcccagcactttgggaggctgaggcaggcggatcacaaggtaaggagttcgagaccagcctggccaatatggtgaaaccccatctctactaaaaaatagaaaaagtagctgggtgtggtggcacgtgcctatagtcccagctgctcgggaggctgaggcagaagaatcccttgaaccgggaggcagaggttgcagtgagccgagatggtgccactgcactccagcctgggtgacagagcaagactccatctccgaaaaaaaagaaaagtgaacataggtcttgcatagtaacaagaaagctcaagtggtgtagatggtaatacttgagtatgtagtccgtctttttctgatggcttatactgtcagtcattaaaattaactaagccatgtgtcaattctaagggggaaagcattaaatcattcagtgtagcctatggttagcattggacccatcataaatcatgacaccactttctaccccataaatacatacaattgtaaattgtcaatttacaataagattataaaaagaacatggacccaagtcatgttgcctagcgttcaaatttcagctttgtaccatacttgcgttatgactctgggttaattatataacctctaagcctcagtttgtttatctgtacaatgagggtaataatagtgtaactacttcatggactgttaaaaggatcaattgaattaatgctaaacatagattttggtattaaggttttatgctggccgcaaaactcatagggtgtacctctttctgttctctggatgaatttatgcgaagtttattatttcttcattaattgtttggaagattttactggtggacccatctggcctggggttttatttatggaaaagttttaattgaagatccattttttaatttggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacacactctctctctctctctctctctctctctctctctcgcgcacgcgcgcgcgctctctctctctctgttccttttgcttactttggatttggtttgctgttctttttctcatttcttgaaatggaaatttagataattgatttcagttgtcttttctaatatatacagttttatattgggaagtattaaattgaatggcaaaacattaaaacttacgatgtacagctcacatcacaacttaccttctatagaggtaagaggtaagttgaggtgtgtgtaaatgatcacaaacatgctgcttccaattattacatgtttatgtagagtcaggtaagtttttaggcaaaagtgttattttgaagtttttatactgttatttggggataagttcttattgtccagctattacagattagatattctatcgtaagtagtatagaaaagagcttctgtctgtctctcctttttcttctttctctgccattttagagaagtgaacaagtcgggggttttttctcccccaaataaatgtgtcagttttattccttttcctctctagttcccattttcgagacataaaatattaaagtgtatggtcacaggtcttggacagagttaagaccttcctgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatcagggggcaaggagttaaaaaataataaagcaggcttccaaagttacatacttcacatcagacatttttgttggacttgtaacacttgacttccgtgctgtagtttcctgtgccttgagaccagctctgtgagcacctgcacagttttactgtgttactgtgagcacctgcacagtgcaccatttagttactaattgaccatatgagttcatgtataaactttgtgagtaaaacatattaatgctggtaaactcatctgtcttcgtgcaagtgcttatttatgcaactctttattttacaactgttaaataggtgcttgaatgataaggcgaggggcccgtttctcttaaagggccatcagcctatagtgaatagaaaattcaagaacacatgaataaaaatcagtttaaaatttaggttagtttcattttgaaagagaaaataccacctgctttctgaattaagagtaaaggtcataaaagttcattcacttagttgtgaaaatattatgcactgttaaaacggggggagagaaagacatgctaaaaatgaggaatgaaagagaaaaatagccacgttagttgaaagtgatgttacttatttaagaaccataatcatgaacttctaaataattattgtttggataatggtttgggtgtagggaagttatggaataattacattttctcccttcaaataaaaaacagaagttataaattactttataatgtataaaatgtgatgtatcatatttgtggaataatttctgtcatggcttatataatgggaaatgtaagcagagaggcagtacacattatgattaagaacacaaactatttagactttgatagaaatcctgagtatagaatttgagctgtgtgatcttgggctacttactttctgagttttttttcatctattaaatggcagtaacatatttcattaggttgttgaggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgttagtagagatggggtttcaccatgttggccaggatggtcttgatctcttttcttttctttttcttttttttttccttttgagacggtgtctcactctgttgcccaggctgtagtgcagtagcacaatcttggctcactgcaacctccgcctcccaggttcaagcgattctcctgcctcagcctcccgagtagctgagattacaggcatgtgccatcacacctggctaatttttgtatttttagtagagacgtcatttcaccatgttggccaggctggtctcgaacgcctgatgtcaggtgatcctcctgcctcggcctcccaaagtgctgggattagaggcgtgagccactgctcccgggcaaccctgtctcttaccaaaaaaaaaaaggggggtggcggggcaatgaagaggtttatcataatgtctcctttgatctgaatcctgaaagagcacttccctatgaattttaacaaaaatatccatgatacctaattagttaatatttgattgttataatagttttatatcctaagttatcaagataatttagttttcttccctctcttattgctgtatcttttgacagtacctgtaaaaatttgtagagacatcaggtggtgcttagtcccacaaagcagataatctgccaaccttgtcttaatattttaatgttattttaatattaatattaaatattttcatagcaagataattataattagtagctcatttgtagtgcctcttttagtgtacaaccattaagcatgtttttgtttggtaaaacttttaggcctcgatgggtggttccagttttgccgaaaggggaattagaagtgcttttagaagctgctattgatcttagtaaaaagggtaagttatatgtttttatgcttcctataatgtatgctactagatgtatttttactttatcccaaaagcggatgaagtggatttgttttcctccatcataaacacatactgcagcttgcaaggaggggctcatatcctttggacattcttaaaggatgtttgtgaactctctgaggtcacataaaatttatatttgtatttctacggagtggattcattgtttcgtcagatttgcaaagaggttgtcactcagaggttaaacatttttaattgagggtcttatctgttatgggaaatactatacaaaagaacattttacaattaagtactctataaatgatggatggtatgatggactccagacatatctgccccctgccctccttgtaattatcttgagtcatttctgtcctcaaaatattactatgtaagtctacaaattatttacacttgacctttgactgctttactgaaatgacagtgaattaggatgtgtggctctttgtactcagtaaaattttacctagtaaaatcttcattcataatccttcaggtaaaaattaccatttcattaatattgtacttctgaaataaactgtctcgcttacatatttgtaagatagggtcttgctttgtcacccaggctggagtgtggcgatgtgatcatggctcactgcagtctctacctcctatgttcaagcaatcattctgcctcagcctcttgagtgggatacaggcatgcgccaccatgcccactaatttttttttttttttttttttttttgagatggaatttcactcttgttgcccaggctggagtgcagtggcgtgatcttggctcactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatatattttggggtaatgagatattttgatacaggcatacaatgcgtaataatcacatcagggtagatagagtatccattacctcaagcatttatcctttgtgtttcaaacaatccagttttactctcttagttattttaaaatgtacaattaaattattttttactgtactcaccgttttgtgctatcaagtaactaggtcttattctaatttttgtacccattaaccatcccgctattctttacgtccgtgagttcaattgtttgatttttagatcctgcaaatgagtgagcacatgtgatgtttgtctttctgtgcttggcttatttcacttaccatggtgaccttttgttccatccatgttgttggaaatgacaggatctcatttgtttttaatggctaaataatactccattgtgtatatgtaccacatttcctttatccatttatcagttaacacgtaagttggttcaaaatcttggctattgtgaacagtgctgcatcaaacatagtagtgcagatatcgcttcaatatactgattttctttcttttgggcatatcagcaaattttggaagacttctttgctaagcatgttctaagtcctgactgtaaaatgatggataaacactgattaatggtatttcatttaatagcattgacattcagtggacatgtattcctccctccaccatattttttttctgagaccacggttattttcaacaagttccaaatttttaaaagtttaaattaccatctcttttgtactatcaatcaaataatactttctgtacaaattgaatagtttttatttggtcattaagagttacagattttctttgtttggaagcacattgctctgttgcctttctaaaatgaggtgaaattaagcaaagatataaagaaacagagacactgagataattgagagaggctaataaggaagacaagacataattcattttatttgatcaaacacagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttggccaggctggtctcgaactcctgtcctcaagtgatccgcctgcctcagcctcccaaagtgctgggattacaggtgtgagcccccatgcccggcctctgttcttttgtatactatggaaatggtcataagttgtcaagcagataatatttttgtggcctataacctatttcccaaatatgaccatagcataaaaattccacattttctgatttaacatgtaattgtataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttaaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttactttttttttttctctatgtgccagtaatccacaacttaagagattcacagggcacaaaacttgatttaacatggctaaatgtaaaatttttagatgacttctggttgaagatagttttatatctttgaaatatagttcttgctattaaacttataaagtgtagcgattgtgagagtgttagcctttcaaagccttcaagagtacaatttttaaaaatatagcccaaaatatagttgcgaatcaaggagaagcatattctatggagttaccttcacatttacttgctattgaagtaagagaaattttatcatacagctaaacaggtcttctataagcttttaaaaatctgattaaaaggggacatgtttggcagcatcttcaaccatgtcctagttgaatgcagatgtcatgatataatgaaaaatctaagagatatgtaatagcctccatatgtttttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgacaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccagagaaggaaagctgttgttggcagctgctgaagctagcctattagcctcagtttgaagcactcttatctgaatattcccaattgtttaagcatacattgcagccaaagaaatacagaaagattagctttagactaattctttactgtgtccacacctgctgttttataaatattgtatgtaactatcaagtatatcaatctaatagtctcattatagttactgaagaaataaaatatattacataatgagcatgtactttcttacaattgctgaatgacaaaagggatctggtgaattaagtactcgagttttaatggttttgaattagcctttcatgactaaaaaggtaggaaaacactattaaattgaaatacgttaatgggtttattagagaaacttagttcattcatattcttttaaaaccatataaaaactagcagtaggccaggcaaggtggctcacgcctgtaatcctagcactttgggaggccaagacgggtggatcacctgaagtcaggagttcaagaccagcttggccaacatggtgaaaccccatctctactaaaaatacaaaaattagccgggtgtggtggtgtgtgcctataatcacagctacttgagaggctgaagcaggagaatcctgcttgaaccctggaggcagaggttgcagtgagccgataatcacaccattgcactctgggcgacgagagtaaaactccatctcaaaacaaaaaaacacacagaaaaaactagcattagctatcatattttctctttaaacaaacattgaacatacagccatttagcatctttactttttcctgtattttttttttaaatagctgtagaaattatttttgcttaaggcttagaagagaaattgtgtattttgctccttgttttccagtggcttctaaaacatggcctaaattttagaaggtggcaaggtgtgaaaggttttcttaggtacattaatttctacatatatttgattcttatatttatatagccttttaattcattttaggtttttacatacagacaggcttttagcctcacaactgttgtctgtgccagctgtatggtactttgagctacagctctttcttagacagttcatcctgttgcatggtgttacttctaagataaggagaactgggtgcaatttgtataagcaaaagtatcaaccagcatattctacttaggaacagtagatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagcattattgagttgtagattataaagctttgtttttttagtctataaaaaccaagaaaacagctttgcctttgagtgcttaaggttccagttttgaaacaatattgttagtgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaatttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactgcaaagataaagacttccgaaatgatgatacgtgaccagtgatgcctttgatgagagaaggaaaaaaaggggttgttattatatctgctgtatcccccctcttctcaggatagtctaaatacaataatggtctgaatataataataattcttcatgttcttccccctttggcttaacatatgtttattgagcacttgtcatttggtaacaagcacttttttcccaaggtgttggtaaatctggcaattcttatggagtgttgaaagtttctgctaaagatgattttgaaaggaagcaatgaagtctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttgggtgaatgcctgttccccccctccccccaccgtggcattatttgtatattttttggattgtagttcttgatatattttgaatgctaatctttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttccagttgtcttagatcatacatcttcattttagaagtgagttttaatcaggatcctggtgcagtccatgtgtatgtcttttaagtctctttgaaactagctttcttcttttttacttcccttgcaatttatttgttgaagaaactggattgtttgttgccttggtgtctgtcaatagttttgatacagaaggttttttttttttttaattttactagagcatatctcaagtggtggtgtgcttttccttgaggaggaatacctagttgtctctctttttataatgttagctagaggtttttaattgtaatctgatattttagtcttacatttttagcagttgtcatattccttttgttattttgtgtaggctggaaggaaataaaaacaggcattcacatcatctttgaagacgtaccatattaataattccattgaactaatcttctctcattaacttaatcgttgttttttttttttttttttttggagacagagtctcactctgtcacccagactggagtgcagtggcgcgatcccagctcactgcatcctccacttcctggattcaagcaattctcctgcctcagcctcccaagtagctgggattacaggcatgcgccaccacgcccagctaattttgtatatttagtagagatggggtttcaccatgttagccaggctgatcttgaactcccgacctcaggtaatctacctgcctgggtctcccaaagtgctgggattataggcgtgagccaccgtgcccggtcagcttaatcgttcttctgctgtttgacgttaagttcgtttcagtttattttctaataaacactgatcagcaacttagtgcatttgctgctgctataacagaacaccacagactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttacactgatgaactggtatttaggtaagagccaagaaaagctcaggaaggtgtattaatgtagatactactcaggttttgactatgtttacttgtgacagttcggtaagtatttattcagcaaattaaatagtaataagggccttgagtataaattatttcattaaaccaagggtccttctgaggagtcttgaaatcagagcagtacatttgctatcagggcttttaactagtaacttcttttttaaatatctattagtatcagtgcctggcatagtgatgtacacattcattcatgaatagttactgagtttcactgaatttagtagactgttgccttttttcaacttcaactttcatttattgtttgggaaaaaatttttaaaagtcattttccaactgtcaccttttcccttctgcttgccaaaactgttgtcaaagtgtacatttgatcataaatgttttcatggccttaaaaatgtacacactattaaacccaacaattctacttagagaaatttcttctcggaaatagtgaaaaaggatacaaagaggtacccacaaggacattcattagtgtttatggacatgaacatgtggaagcctcctgaataattactttttttttttgagacggagtcttgttctgtcgcccaggctggagtacagtggcgcaatctcggctcactgcaacctccgcctcccaggttcaagcgattctcctgcctcggcctccccagtagctgggattacagacacgtgccaccacacccagctaattgttttgtacttttagtagagactgggtttcaccatgttggccaggctggtctcgaactcctgacctcaagtgatccacccgcctcggcctcccaaagtggtgggattacaggcatgagccacagctcccagctgtgaataattactaatagtttatacaaggttcgattatggcgccattaaaaggattaatatcacttaagagtatgattctaattttgctgccgaaaaaggaatatctgtgtattacaaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatagagataaacactgtaagaaattgagacatatatctcgttaacaataatatttgaggagcatattttgagtatgtttggctcatcgtacatatttcggcctttctcaaatgaatgcatttatctttcgaagtagacacagtagttcacatactctcccaagaacagtggccttgtctcccctaaaatagtagtagtggatgtgaaagttgattggtttcagtgaaggtagcaaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggcttctcagtatatactgttcctcttctgtcttatgacaaattcatacccctttccccactgatactttgttgtttcaagtttgtttcccgagcagtatgtaagaaaatactgtattacgaatgttagttatagagttaaacatactgattactcaacttaccattcatttaacatgttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgaggaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatacgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctagaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaatcccattagctatgaggcattaggttacttggcatgataacatcaggctttcacagtttactgatattctcaatttctgataaccattttaccaatggtttgtgctgcctgtattttatcttcactagcatctttagcttttgggggaaaaacatttcctcagtaagcatgatcagctgattttacctcctataaacattatttagataaaagaatgaacttagtaaaattctctacagtatttactcatgttctcactacaagtgttttcatacactggtacttaaattattctttaaaagtttttcatatgcatacaatgaagtataaaccaccttttagttttcactcaagttttaactcattggtagaatagtcattctactgacttcaatacttaccgaaagtttaatttaccattttttcttgtttctggatagagttggatgacccaacttcactgtaggtcagatttttccactctgtttacttaggatgctaccttctgttacttcttcccggtcttttccatccaacagtaacagtttttaggaacgttttccacacaaaaagattgctttatgagtgtcattcaccaacagtgctatgttagggtgcagatcctgtgctagattttctcaggactcattccttacatcaactatgaagtactattaagtctgtgtgacttctctgtggtttaaaaataattacatactatccattttgtgaacaatttgtaccttcttggagaaacggctgtttccaggcgtggaacagggaaagtaccacatgatccttgaccatcctattccagaaagtaagaaagtgctcaacgatcatgttgacatgtcaaaaggacacaggagttggctttcactggccataattaggtcaaaattagtaatgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggagaaaaatataaacaatagtcatttagagtacctgaaaattgtcctaagagggagtatagcaaatgggaaaacactcaagaaaatctattaaatctgcaaaacagcaagagtctgtagcatttgagccacagcttgttctgttctcccatgttcagatccagctttcttgtgtggaaactctactccaggcaggtgtgactaagaagcaggggctccttccctgaggctgccagtctagggctgtagtttgaccacatgaggtggtgtgggctactggcatttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcctaagggtattatcacaaatggagatttgggtgatgaagaattaggagagtgcttgtggctcccttatactggtatcagcaagtcacaggatgagcaaccagaaatttaacagaaagatctagataaagagatggccaagacaagctctcttgtgatcacagtcaaccctgggggtcaggaatgctacgtgtatgcattaggcttcacctaagcagaaacaatcagaactggacacgggacaaattgaaaacattccccaagcttcatgtcaatccgtcagcaaagggtgaaagcctcaccagtacagtggacttaaatacagctctgaccaaacaaagcattgggtgaataataagctaccccgactcaggggcaactcttaggaagccagacatgaaaattacatgtatccctggcagtctggaagacttgctgcatccttgctggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacagacatctgtggaatactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcctcccttctgtgttactcgccacaatgcttagactgatctaattatgacgaagtggcatggaagcccaaattgagtgacatttcaacaaaattgacctccagttttcaaaaaggtcaaagaacacaaaggatgattaattctgcagattaaagaatagaaagtcatgaaaaccaaatgcaatgtatatttaatcttgggctttgtagaaaagatgtaaaaggacgttattgggaaaattgatgaactcgaatatggaccatggattaaatcagtgctcctccgagggggtggaggtggctatttgacagtgtctggagctgtcttaaactggggttgaggggtgggtagaagcctggaatgttactaagtaacctatagtgcagtcctagacagaacagtcctgtacaacgaagattacctggccaaacgtcagtaacggaaaccctgggttagatgatggtagtattttactagtgtagttttcttgttatttggaaatactcattgaagtatttaagggtaaaaggacatatgtccaactcttaaatggtttataaagattatgcacacacgtgtatgtgtgtattttttacatgtgtggcaactaatgaagcaaatggaggaagatgtaaacaattggtgaatacaggtaaagagtataagagaattcttgcctttttttttttttttttttttttttttggtgacggagtctcgttctgttacccaggctggagtgtagtggcacaatcttggctcactgcaacgtccacctcccgagttcaagcaattctcttgcctcagcctccagagtagctgggattacaggcgcctgccaccatgcctaatttttgtatttttagtagagacggggtttcaccatgttggccaagctggtctcgaactcctgacctcaggtaatccgcctgccttgccatcccaaagtgctaggattacaggcgtgagccatggcgccctgcctttttttttttttttttttttttaaagagacaaggtcttgatgttgcccaggctggagtacagtggtgcaatcatagctcactacagccttgaactcctgggctcaaaccatcctctcacttttttttttttgagacagggtcttgctatgttccccaggctggtctcgaactcctggcctgaagcaatactactgcctgggttgggcttcccaaattgctgggattacaggcatgagctaaaacttgattttctttccagtttcttaagaaaacctcttgaagtagtcctttaagtcccaatctctgatgaaatatgcattcctgaaagtagagtgtttatgcctgtttgcatattccaatatatgtggaattagaaagtagtttggtcgtaatatatggggcttttttctttaccaaagcatcaaaaccaaatatgtttccagacattatgaatgtcccatctttataacacatcaggagtttgttcagagaagaaacatcaatgttttgaagaatttgattactgatttccaaaagagcttacataattagaatctttaacaatagcttgcacataccatagggtctgggatctgatatggaaatatagtaattaatgctgaaggaaaatgacacattctggacattaacatggtaatggtgacaattgtatgataacttggtcatgtagagtagcatcttgtgttaccctcacttcttaggtgtaaattagtaatatttatttttataccaaaataattttttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgattgcaccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatggaaaacctttgaaaagttaagcagttttaactcataaatattgatggattagttatttgtgaaagtcacttgattgaatacctcatttttcaatgatgccatataagcaggctgctaagtcttttttctggttgttgttgttggagacagggtctcacccaggattctctacttaaatatgactgttgttaattgagtgctacaattaaattagccattgccatctttaattggagtgcagcggcacagtcttggctcactgcaacctccgcctcccgggttcaattgattctcatgcctcagtttccccagtagctgggactacagacatgagccaccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaacacatcttaaaactcaaaatttgcaccacactacaaaagtaaactgaattgaacaaggaaaatatgttttcttacttggtctccccatgcttatcccctttcccctccccaacccttttataggggccaacactgaaacacttcctcaaagtcccctagggttctgaacatagtttggaaaccactaatgtaattagatgagtgataaagatttatagaaactgggggtagagtagtcctttatgctaaactgtgtttcatgtaatctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacctttccacctcagcctcccaggtagctggggctacaggcacaggctaccacacctggctaattttttttgactttttgtggaggtggggtttcactacattgcccaggctggtttcaaactcctacgctcaagcaaatcctcctgctttggcctcccaaagtgctgggattataggcgtgagctacagtgcctggcctgtaaagagctcttaaaagctgccttgcatggcatataacaaatattttcaaatggtgtttatagttttgggatgttttgtgtagtcaatgccatcattttttttaaagagttttgtttattaatcatgaaattatatacagttgcttcttgaatatgatttttattttgtattttactttaaaaaaggtactataccaatataaatagcattttggagtgaattttgatatgaaggcttttttccagaaaaaaaataaagtgcattgtggcatttttgttgatgcttttaacaaaatgtaaaacgaccttttaaatgtaaaaggtaaactctaccttctttttttgaatttttttttttattaatacaaggtctacctatgttgtcgaggctggtcttgaactcctgggctcaagggatcttctttgcttggcctcccaaagtggtaggattacaggcatgagccactgcgtccagccaaccttttacatttaaaaatagtcttagtgagttgggcttttacagcataaaaataagcgttatatcttggatttaatttcattttagtagacacctcattttctgcaaccatagatacaagactaacaacaatagaatatgattatgtttttaaatattatttatatttttagttaaaaggagcaatatttttttttcttttgcatttcactcttgttgcccaggctggagtgcagtggtgcagtctcggatcactgcaacctttgcctcccaggttcaagcgattctccagcctcagcctcccaagtagctgggattacaggcgcccaccaccaagcctggcttattttctgtatttttagtagagatggagttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtacagttaggcaccagataatgacgtttcagtcagtgatagaccacatatacaatggtggttctataaaattataataccatatttttactgtaccctttctatgtttaaatacacaaataccattgtgttataattgcctacagtattcagtacagtaacatgcttgtatgggtttatagcctaggagcaataggctataccatatataacctagatatgttgtaggctgtatcatccagatttgttgtaaacacaccctatgatgttcacacaatgatgaaatcacttaatgatgcatttctcagaacatatgcaacacgtgactgtaatctggagataatttatacaggaagatgtgcatcggttgtatacaaattccacatcattttatataaggtatttgagcatccctggattttggtgttgggagggtggatcctgaaaccatccctgcacccccaccccccatggataccggggaataactgtattgcatttagttaatgtatctctttagtttccttctgaaacagttcctcatactgtctttgaccttcatgaccttgactcttaaagattacaggccagttaattatagaatgtccttcagtttagatttgttttatcatgattgtattcaggttatgcgtctttggcagaaataccacagaagcgatgttctgttcttctcaatgcttccagtcagatagtatgtaatttcaatttttcccattactgacgatgatcactgtgatcacttgagttttttccttgcttccccactgtaaaattacccttccctttgaaagtattttgggccaggcacagtgactcatgcctatcatcccatcactttgggaggccgaggtgggcagatcgcttgaggccgggagttcgagaccagcctggccaacatggcataaccccgtctctactaaaaatacaaaaattagccgggcgtgttagtgtgcacctgtaatcccagctacttgggaggctgaggcttggacctgggaggcggaggttgcgttgagccgagatcatgccactgcactccagcctgggcgacagcgagattctgtctgaagaaaaaaaaaagtattttgtgcagaggtactttgaaaatatttatactgttcctcatcagacattttattcattcgtttatatctgtatgaaatcatgatcaaggagttataatctgttactatcatttatcttgatgctgaaatgatctcgtttggccagtgggagtcctttcagactgttctgtgttactttaatatgttcccattattctttcagcacttgtgtgctctttggctcaagatgtttaagattaggtcaagtgtagtggctcacgcctataatcctaacactttgtgagggtgaggcaggaggatcactggagctcaggattcatgaccagcctgggcaacatagccagacttcatttctattaaaaatttcaaaaattagccaggtgtggtgatgcgcacctgtagtcccagctacttgggaggctgaggtgggaggatcacttgagcctgggagatggagactgcattgagctatatgatcaagccactgtactccagcctgggcaacagaacaagacgctgtctcaaaaaaaaaaaaatttaaaaaagttccagattaacatcctgtaccctctctgccccagtcctgaaattggctgtttctccaaggaggcctgtttgatttattttcctggagaatggtgtttagaaaccaagatctggacatttattgcactcattgctatcgatgtattgttgctccctggctctctaagcagttagagctaaggaatgtgtgtatgtgtatccacatttaagtctattactatatatatacacacacacacatgaatatatatatgtgtgtaagtttttacaaaaccatggggtcacacgacttcctcccatcccagcctatcacagtttcattctagttttctccctttctatatttgtaattttttttttttttgagacagagtctcgccctgtcacccaggctggagtgcagtggcgcaatctcggcttactgcaacctccgcctccctggttcaagggattctcctgcctcagcctcccagtagctgggattacaggcgtgagccaccatgcctggccaaactctcttttctgacaatgaaaaacctggcttctgttatcctctcacttattttcctatttaatcagttatctccagaccccccaccctttctttgaacgcagaaggactcttgtctctgaatgttgggtctctaccccagggacactcctcgctctgcttgagttgaatctttatgctgagctctacccacttattgggctccctcctcctccttcatggtctgtaattcccaacataggactacctttaaaacttgcacatagtttaattagagcactcataaaatgataattagtatcctcagagataatttggacagtccaggcaggtacttcagtgtggctgaaggcttcctcaggagatagtaaaaagacacaaaaccagtacagaggaaatgctgacttgacattgctgagatacagtgcaaaagagtggagctctgagatagatgggctaccattaagataggcacagggggaagtagaacctgccaaggtccatgaaagtctagtttaggattgtatctcacaagatgagcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaaatcacacatgaacaaactcaccttctgcattatactgacatcattatatttgccaattgattgtgagctaattggggttatagaaacgtgctatagcataacagactgtaattatttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaatttttttaaggtactttattgtactttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccctcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtcttttgcccattttaaaaatcggattttttgctgttgagttccttatatattctggatattaaccccttgtcagatgcatagtttgcaaatattttctccaattctgtagatttgtctttttgtggtcttatttcctttgttgggtagaagctttttagtttaatgtaatttcgtttgtctgtttttgtgtttgttgcctgtgcttttgaagtcttagccaaaaagtccttgcccacactaatgacatgaaacatttcccttgtgttttcttctagtagttttatagtttctggtcttacatttaagtttttaacccatcttgagtttatttttacatatgatgaataataggggtttagtttcatttttctgcatatgtatattctgtttttgcaacaccatttttattcaagagattgccttttcccccaatgtgtgttcttggcacctttgttgaaaatcagttgtttctgattatgtggatttatttctgggttctctattctgttcaattgatctgtgtctatttttgtgtcaataccatgctgttttggttactattgctctatagtaaattttgaagtcaagtagctgatgccttcagctttgttcttcttactcaagattgattcggctatttggagtcttttgtagttccatatgaattttaggagtgttttttgtatttttttgttttaccttgcagattcacctcaaaggatgttttttctatttctgtgaagaatataattggtattttaatagagattgcatcaatctgtagattgctttgggtaatatggacattttaacaatatttgttcttccaacccatgaacatagaatatttttccatttatttgtgtcctgtgttcgttctttcatcagttttttttgtagtgatctttctcctccttgcttaaatttattcctaggcatcttatatttttgtagctattgtgagataactttcttgatttctctttcagatagtttgctattggcaaatggaaacactacttagttttgtatattgatttttgtatcctgcagttaactaacacaggttcacgcttgtaccagtccagcttcctagtcatcttccattccgtatttgtatctctacagcaatgagaaatctgaaacctgagggagttggaaaggcttcttaatcagtcttcagcctctgtctttaggccttcgaatcatttgtgccttcccaagtgtttgttgttttcatacccttggcttttctcagatttagtggggcattaatttataggcaccctcttctccttgccttcacaacaactaaaccaacttcacaacttcagctaaaccaactatctatccccatcttcactacaccgtcagtaatttgttgacagctgtttaatgtgttgcttccccttctgtttttatgttcttttgagtttatgtatttttatattcattcattctcattttagtggggtttggggatgaagtactgataaatatagtgcagtacaccatatttagttgacataatttttaaagctgtcttctgcttttattacctccattttctaaattaaacaccttgttgggcttctcatcttgctttgcaattattatgggacagaagcatttcacattagattcttagctaaggcttctctcaaaagatatatttcattcttgtctgttacatcgtttagaatttacatagtttcatttgttagtatttcagtaatagtccttgcagtgctttactgcagattcaaccttcacaacatactgtaaaaacacaaacccaccactgaatccttgatcttgtgattggcgcttaatgccaccagatggcgagcatgagctcttgtcagacagttaaggcaagaaacttgaagtgggtgctttcttcatgttttatataatgaaactagaatacctaaatttgaaacagccagcttttgaaaaagctggtaatggttgtattgcagcagaaaatcataggctttggactcaaatggacttgagttccaatcctgcttctaattgctactctatggcgttaaacataagtttcatagtttattagagcttccttatccttagaactgggataatgataacttttttgtgtaattgcagggattaaatgaaacaatgtatggaaaacccctagcctagggactggcacttagtattcattaaacattaaaccactctctgtcacttccttttcttagagctcctgcttcctttcttatttaagagtttgtgtctaaaacgtggtaatacaatcttttgtaaaagtctgttgtaagctcttagcactgataaactcaacttaaaccacacatcatctctataaggtatagttaatgactaggaaaaaagctaatgattctctctttcccctccatttaaaatacatccaagagtgcacaaatgctaaatgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagatggacgccaccacgcccagctaatttttgtattttttgtagagatggggtttcaccatgttggtcaggctagtcttgaactcctgacctcaagtgatccgcccacctccgcctccctgagtgctgggattacaggcatgagccactgcgcccggcccacacctggcttattttgaaaatttttttgtagtgatgggggtcttgctgtgttacgcaggctggttttgacctgggctccagtgatcctcccatcttggcttcccaaagcttaggtatcttttcaaaaggctagaaagaaaccaaaatcgtcataaactctggatgacaagattatgactggcttaaatttttctggcttccattttttataaaatgtaacatgatataatcagggatgaatatgagagctggaatggccactgagtgttaactttgattcagatctctcaaatgagtaaactataattcaagaccattaaatgatttgcttagaattcactacttctgaccgggtcacgctggtaatcccagcacttcaggaagccaaggtgggaggattgcttgagcccctggagtttgagatcagcctgggcaacatggcataactctgtctctacaaaaaaatatgcaaaaattagctgggcatggtggcacatgcctgtggttcccaactactcagaaggctgagatgggaggatcacctcagcccagggaggttgaggctgcagtcctcacgccactgcacttcagcctgggtgacagagtgagaccctgtctcaaagaagaaaaaaaaatatccaccacttccttttcttgagctcttctttttttttttttcctcctactcccctttgcctccatccttcactcagaatatttttaagccaagcaagatactatgagatacagtggttaagcatatgaattgggttgcttttagggagtaatttgacaatgtatgtcaagtctttgggcattatgttcaacttctttatgcttgcagggttttgcatggtgaaaattataaaaattcagctgctaggatctttgatgtttaaaaaggtgaggggaggtaaaaacctaaatgcccaataataggaattaaactggtaaaataatattgtcattttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctcctgcctcagcgtcccgaatagctgggattacaggcgcatgccaccacgcccggctggtttttgtatttttagtagagatggggtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaaaatggcttaaattttatattgttttgtatcacaggtcccatctttgttaggatttttttttttttaaagtagttcttattaggtaagtaaaaagacagcttcttgttaggataaaaacagatttttgtcatgatccctgacacagatacttaatgaagtacacagaaaacaattacatgtttccactttcacctttcttcagtatttattcagagaatgtgccactatggatacagaggtacataataacctctaatctcaacgagctcacagtagggagcccaatgcaaacttagtaatatagaaatatcttaaaataatattgttgaaatatttacagtatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagattcggtgaattttgacatatatgtgtgaaaccactgctgcggtcgaaaccgaatgttttcatcactctttatgcacttttgcagtttattctttccccaggtaactactgctctttttgtccctagagagtattttttgtcttctggagttttatataggtggattatagtgtgtgttcttttgtgtctggcttctttcactaagaataatgactgagaattacctgtgttgtgtggattagtagttcattcctttttattgctaactagtacccattatgaatattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaaattatctacagaagagaagctgtggttggctttttgatttatcatgtgtacctgcccctgatgctacatatttagaaggagaaattgagttacaggaacttccctgacttggtagagcttcttttacatggccaacatcaccctgatttgcccaggatatatgttgatgttccatagtatctgtctggcacagccctgggtattcattcagcttattaactgaatacttattctgtttcaggcatgtactgtagttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgttttcatttcaagagcatttaatcagtggcagtaattttgttttgggtttctttttctgcaagtcagtcagatttatagaaaatgttggtttccatcctcttgtatcagtctgatcctgatcttcgtatatggtaactttattaacttgggctctaatttgtgtcactgttgtatgtaattaacttgttttatctgtattttgtgaaaagacacagaaaatgtttactttcatcattccatcacatgccattcaataatgacaaaattcattgatgaaaggttgatgtaaattcacaataagtcatttgttgaaatgaaacatagtaataattaaagttttaaaaatgtacatgctgtggggggtagggttcaacttgcccactcgagaggatgtagagtctgaagtgggaatgtcactttagagtctaaagtgatttagtgggtttaaagtgtgaatatcacctattttaagaaggtccttgggtaagttctttgaagaaatccagtccagcctattcagaaactcttaacaggatccccacaaatcgggttgggcgtgctacctccttgagaagacaatcctgcacgttggaaaagataaataggtttagtaagtctaattccatttaatgatgcatacgtgtgggaatggtgaggataggaaagatgattagccaacagttttaatgatgtcaaacctggagggtagcaagtttgttattctatgttgaatttttaaaatcttaaattaggaacttatttcatctcttagtctactaactattaaggaacttgatttaacagggttttttgccctctaccctttatgaaaattacccttatataagtcagaaccattttgcccctctcttccctgaaacttgcatgcagtgcggtaatgtactgtagaaagcatgttatctcattatgtcaccatattgtctgcaataatagggagggcgttctaagttaggatctttttgagttttaagtacctgattttttataaatatctgaatacctatgtaggttcaaaatccattatttcccgttagtaagaatttgtcagcaagtccgacttggacattaattattggcattaatattctaaaatctgaatccccaggccgggcacggtggctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatctttccatgtcttcccgttatctttgaattaagttcaaacttttaaatttggcttataagcactccataatttggtccctgcttctactcattcagaagtttcaacttaaatgccacatattctagtaacttttccttatccctaatctaggaaaggtttcctagacctctgttcctgttagatggtctgcttccacatcatgacactgactttattttattgtagttagttgcaatggatttaaattcttttagataaacgatatttttttctgctgtttccacagcctgttgttttattccctgcctagttaactcacttatgttacctctctgatccgagaaagcatttgactttgccactcctgggatagtgctttcagagcagagctgagtatttggttaaatgtttagaaaaggagtcaaggataatactgtacaggaggttagtgggagtcagtttgacagaaggcctatggtgctaaggtctaagcagtgtttgatgttaatgtggtgtaggcagtctcatgtatatgtttggtaaatattgatcaaatacctattgtctacaagacactacccactgtggatatggcaaaacagacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtgtatgtccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccggagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttcttttgaagcactctagaagtctgcatttgctcagggaagttctatcgggtattcacgagcatcaactttttattgcccctcatatttgggctgtatacctagcttattgaaaaattagtaaaccaaagcagtgggaatagcatacctttgaaaatctgattaagttatgggcttgctcccagaaaagtagatacgcctgactttggtttacttgggttccccccaaattctacctccaaaaattttaggggcttctgaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtgtgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcagaagtggaagtactagatcatttggtgatgctatttttattttattatttattatttttttcagacagagtctcactctgtcacacaggctggagtgcagtggtgctatctcagctcactgcaacctctgcctcctgggttcaagcgattctcctgcctcagcctcccgagtagctgggactacaggcacgcaccaccataccccgctaatttttgtatttttagtagagatgggatttcaccatattggccaggctggtctcgaactcctgatttcaggtgatccacccaccttggcctcccaaagtgctgggattataggcatgagccaccatatgcggccaaattttttgaggaactgttttctagagtgactgcaccattttacattcctaccagcattgcacaagagctccaatttctccatatccttgccaacacttgttatactcactcgttctggtagttgacaccctaattgagtgtgaggtagtatctcatggttttgatttgcatttaccaaatggttaacgattttgagcatctttagctgtgcttattattggccacttgttgatcttctttgtctatttttaaattgagttgtgttgttgagttttaagagttctctgtatgttctagatattaactccatatcagatatgtgatttgcagatactttcttttgttgcctgtacctctgatgtcatatccaagaaatcactgccaaatccagtgtcttgaagcttttgccctatgttttttttttttttttaacagttctgtggttttagctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacagtaacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggccttttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaatacagtatttcttcagggttataaaataacaatattttattttttcatttaatagctagaaaagatctataaagggaaaattgccctcaccattttctttttaagttagaaaactcagattacatttttatcttgtttcctttgactttaagtcagtactacgtcatgcactgtgctaaaataactacagtacaaccacgtaactcttactgtgtatgaaaaggggtataattctttatagcagtgaggtttggtttgttttgttttgtaagtaatcctccttggaatcccttcaaggtgcttcccggccagctgagaggagcggggaacgaagggtcacctgatactctgatccgccttcccttcttctgacaaagcagtataaatttcttttcctcccctaactaggccctctacttactctgtactagtgtcttgcgtggaccaccctccctcccatctctcattttgcttttagtcccgtcacccagcataccattctccctcctctctgactatttcagttctgtcttctttccctaggttattccaattccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcgtgagccaccgcgcccggccttttttcttaagttgatagtgaagttgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttagagatcgaatctcttgttgcccaagctggtctcaaaactgctgacctcaaaatcagtcgtcacacctcaacttcccaaagtgttgagatgacaggcgtgagccactgcgcctggcctactcttacattcttttacagaagattattcctgaggaaataaaatggcattttgcatatagctacaggtgttatttataaatttgccctttatcttagaacttgagtgattataatagtgtaaatacagtaagtttagaagatgacaaagctatggtagtatttcctatacaaatgaaataatgacttttaaaatagcattgattattgtcattatctttaaggtatatttgtatacaaaacatatcaaacctattgtaaaaaaagattttacccccgtccgggaggtgaggggtgcctctgcccggctgcccctactgggaagtgaggagcccctctgcccggccagccgccccgtccgggaaggaggtgatggggtcagccccccacccggccagccgccccgtccgggagggaggtaggggggtcagccccccgcccagccagctgccccatccgggaggtgaggggtgcctctgcccggccgcccctactgggaagtgaggagcccctctgcccggacagccgccccgtccgggagggaggtgggggggtcagccccccgcccggccagccgccccatccgggaggtgaggggtgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttaggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcaagaaacacccaagaatgatcaattaaaaaaaaaaaaaaaagcctaaaaaaataaaaataaaaaaagattttacaagaaaaacattgacaaaacaaattgtttgacttgaaaattgattaagggcttctattagaaatagttaatgagttcattactgataaatatacatgcctgtcatatggaagttttactttgggacttgttataatatggattaatgttgatttgcaatcgtttttcaccaaaatgtcacagtaagatagtattttctacaatccaaactgtattaaatatagtcatgggttgagtacacatgtggtttgtgggggtgttttgtttttgattaccaggaaatgattgggtgagaggtaatactatataaatgagaaatttctagcaagttatagtcttaccactcattcataattagggaatatacttattcacttagcctaggcaacttttagtccttttgaaaggccttttatattaggtgaacaataaaataaaattttaaccttgtttttaattagtgataaaaacagccaactttggggtcatttgttcatgttactcctccttagttttagacaattttctaaattatttggaaatcactggttttctttggcaagtgaaatgtcaaaagattatggtcttgaaatcagatccttatacctgatcaacagctaaactagtcttatttttttaactagctgggcatgggggtggactcctgtagtcccagctgcttgggaggctgagtcaggaggatcgcttgagcccaggagttagaagttccagtgaactgtgatcatgccactacattccagcctgggtgacagagtgagacctcacctcattaaaaacaaaaaagaaagaaactctactttgagtgcccatacaaccattctgtttttcactctcagtacagtattcattgaattacatgaatctttgtgttacaagattttgcccaactgtaggctaatataagtgttctgaacacatttagggtaagctaggctaaagctatgatgtttggtaggttgggtgtattaaatgcattttcagcttatgatattttcaatttatgatgggtttattgggctgtagccatttcataagcaaagagcgtccgtacttgctgcagagaccatatgcttcacaaagcctaagataaatttactatctggccctttacagaaagactttgctgtcctctaatgttagaacaccttctttttatagatgttgaagaatatcctacttttgaagtgtagtctaagatctaacttttttccctctatgggctgttccctgattatatagtaaaaatttgcttaatacctgctttatattccattcatataatttataaatgcctttgtgtaccttttttccggagtttaaaattccttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaatcccagctactcggaaggctgaggtgggaggatcgctggagcctgggaggttgaagctgcagtgagccatgactgtgccactgcactccagcctgggcagcagagcaagaccctgtctcaaacaaaaccaaagattacaagatgagactgaaaagtgtaagctacttatgaaatttattaggttttagcttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagaggattgcttgagcccaggagactaacctaggcaccatagggagaccctatctctacaaaataaaattttaaaattagctggatgtagtggcatatgcctgtagtcctagctacttgggaggctgaggtgggagaatcacttgagctaaggaggttgaggctgcagtgacccgtgattgcaccactgcactccagcctgggcaacagaatgagaccctgtctccaaaaagcaaacaaaccaaaaagtcatatatccaaaatgaagttctatatccaggcgtacctgtcgtttcaggttttttttctgtgatcttacttaatcaccattggatccatggcccttttaacataagggagattgtacttttcatttgtctatttagtttgtcttcttttcccttgtcttttccgtaattgcagatatttgggtatttgtagatgagaaagagaatatttattacacagacaagcataagtggaatctgtatttcaaacttaaaaatgccaaatttagacattcagaagaatcctattctgttcaactcttttagatattgcctgttcacaaagcacacatcattgttccataatgtaacctacttgtaaaattttcctgctgaaaacaaatactgtagggcctgtaaaccttaatatgaagtccttaagatcagatatgcattgggattgagaattgtttggatttaagaaaagcaaggcagtgcatataccaacatctctatagcagggtctgagacaacaacttacaattgaacacattaatatttctacagtaaaatatgaatatttatactgaagggagaaataaagactataagtagcctttagtcagtttgggctaggttatcccaccaaccacattttgacagcaacttaatgaaaaactttgttgggctgggcgaggtggctcatgcctgtaatcccagcactttgggaggccgaggcaggcggatcacctgaggtatggagttcaagaccagcctggcaaacatggcgaaaccccatctctacttaaaaatacaaaaattagcagggcgtggtggcgggcatctgtagtcccagctattcgggaggctgaggcttgaatctgggaggcagaggttgcaatgagccaagatcgcgccactgcactccagcctgggcaacagggcaagactccgtctcaaaaaaaaaaaaaaaacttgttataataatagcttttgggccaggcgcggtggctcacgtctgtaatcccagcactttgggaggccgaggcaggcagatcacaaggtcaggagttcaagaccagcctgaccaacatggtgaaaccccgtctctactaaatatacaaaaattagccgggcgtggtggcacatgcgtgtaatcccagctactcaggaggctgaggcagaagaatcgcttgaacccagaaggcggaggttgcagtgagctgagatcacaccactgcactccagcctgggagacaaagcgagactccatcttaaaaaaaattaaaaattaaaatagcttttggaatcttaggatttcagataagaggttgtggacctgtttttattatgtttttgggaatatggcaataaataagattgtctaatgggatatagaagcaaataatgtagttgccataaaatatgttaatagctataatagggaaaatgcaaagtgcatcacggggggcatggtacctgaagggatttggggagtgcagaagacttaatggggaatgtaacgtgggaattggttagttgagctttccatctagagtgtgaacagcagatgcaaagacttgataaacttggcgtggcttattggatgggatgaaaattgtccagtctgactagaattgatgtaagatgggaatggcaggagtttctgatcatgcagttctaataggccttgtgagagagactgaggcattggatgagccattgtagggttttgaacagataataccatctagaaagagcactgtggccacagtgtggaatgtattgcagtggagtaagatcccagagagtgttaaaatgatctatagacataagatcattgtgacctgtactggagaactggcagtgagggagatacaagtggacagatagatatatggtgctttttataagaagtggaatcagtggatttggtgatgggatattcagagaaggaggggacagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcctggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggttgcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcctggcgagagagcgagactgtctcaaaaaagaaagaaagtgttcatcttccttacagtgagccggtgtgattggaatgtcatagtcatagtcactgttgaacaatgttaatacttatactcaatgggtgagttttcttttctagtaaaataattctctgaatgctaagtaaaagtgataaaattacaaatcaaaatttttctgatcataaaaattatagacaagatattttgtataactacttgttttattcatgaagcccttgccatcttaattttttcctcatatttttctccctctctttcttctccccttcactcctttttgttgtaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaaatttgaatgctccattctttacactagttttgtttgtttgtttgttttgagacagagttttgctgttgttgcccaggctggagtgcaatggcgtgatctcggctcactgtaacctccgcctccctggtttaagccattctcctgcctcagcctcccaagtagctgggattacaggtgcccaccaccacgcccggctaattttgtatttttagcagagacggggtttcgccatgttggtcatgctggtctcgaactcctgacctcaggtgatctgccgtcctcggcctcccaaagtgctgggattacaggtgtgagccaccatgcccagccctctttacggtagtttttaaatgctgctgggcatatatagtactaagagtctggaggaagatttttgctttggaatattttagccctgtaccttttttacgtgtttaatgggggtcttttttctgtctccttgtgactgaggttgataccatgtttatgaaatagtttaagaattaactttttaggctgggctcagtggctcatgcctgtaatccctatgctttgggggaggccaaggcaggagaatcacttgagctgaagagtttgagcctgggcaacatagcgagacttcatctctactaaaaattaacaacaaaaaagttggctgggtgtggtggtgtgcacctgttgtcccagctactcaggagactgaagtgggagaatcacttcagcccaggagatcaaggctgcagtgagctgtggtcatgccactgcactccagcctaggtgacacagtgagaccctgtgtccaaaaaaaaaattaactttttatatttagattttgtatttttatatcttggtatatctatctgatcattataatgcataatgttactttcttcgttgtgcttaggtaacttgatttaaaatgttatttctctaaaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttacatttttatcaaccagtcaatacataaccttgttgtatgtgtgtttctacttaaagtcatttaatatattttgttgactcataaagttcacagccaacagctctgtaacttaagcctgaacttaagcttctcaatgcattctgcataaggcacatcacagccttcttgtggttaggaacattagatagcacttcaacattatatacttgggtcattttaaacataaaaataaccagcaaaagcacaaatatgtggaaaatgtggcactaaatacaccatgaagaaggacacttgtttacagtttaagctgaaacaagagagaatgacactcttctggacttcagctaggaacgtttgtgttggacaacttgatatttttgctgctctgtatatgtccacagatgacgaagaaagcaccttgatgattgattttgcagttataaataaagtttaggaagtaagcgaattcacaaatgtggaattcatgaataatgaggggatcaattataattagtttttatgagaacttttagaatgttaacttttttcccccgtaaaaactaaggttatccagcttaactggccctcaaactttcactagaatttttctatttgtttttgggggtttttttgtagtaaaagttgaatatattatctttaatcccaagagttatataatagatgataaattatggtattagttgacagcactgccaggttttagaacttcccttcccacatggaagatagtataatagtttgtttgggaaaacaattcaaagtctatgtcgcagtttgcctcccatctgccaaggtaataaaacaaacttaaaaacaagttctgtaacaacaaaatgcttaaagagaagtaacaatctggagttttagtggggattgcgaaagccagaatttgcaacttagtattttcaaattatctccaaatttaccataatagatttcaaacaaatactgtaaaaatagcattaaaccaaaaatcaattttcgtgagacacaaaagatagtagctcagaattatagtcgtttattcaggcagtattcagtgcccttctaaatatgttcataggatttgaaagcttccttcagagtagattttaatgaaatctaacttttactattttcttttttaaaaatgctgtatttctgggcacagtggcttacccctgtaataagcactttgggaggccaaggcaggagaattgcttgagaccaggagttcaaggccagcttgaccaacatagcaagatcttgcctctatttttttaaaaaagaaagtactgtaagcacttacagttttaaaccagttaatcacatcttagctcttgtttgattagagcaagtgataatggcaaagacatacgtgctagattaaatgtgggaattacacttttgtgtaatgagattagtaagatactgttaaatgaatcactggcccaaacgtgaaaataattttctcataatgagcttttagttcattcagtaaacaatgttcaaatatttatagagtgtctaccatgtgcccagcactgcttggcatcaggtaataaggcaagtgaagatagtattaataaaaatggcatttgagagcagttgatgctaatggggagaaaatatgatatggcagaaataatgatttagcacttcattgttacttgaaaaaactgaaggtaaaagcaatttatatgtagtgtttcagatgaaacagcaagagggcctgaacatggttgatttgtctgaaatgattaagctttgcaaaattgttgaagtaatctgttttgtttggaaatcatgaatgcatttgatggaggaaaaaaatcttactttgactttaaacatactgttaagtaaaatacatagtgtatattagaatctttaaattctcagtgtccaggttatgttttctaattgaggtaaaatttacataacaaaactcaccatttcaaagtatacaattcagtgacttttagtacattcacaatgttgtatagccattaccactatctgattccagaacttttttttttttgagagggagtctcactctgtcacccaggctggagtgcagtggcgcgatctcggctcactgcaagctccgcctcccgggtttacgccattctcctgtctcagcctcccgagtagctgggactacaggtgcccgccaccatgcctggctaattatttgtatttttagtagagacggggtttcaccgtgttagtcaggatggtctcgatctcctgacctcgtgatccgcccacctcggcctcccgaagtgctgggattacagatgtgagccaccgtgcccatcccagaacatttttttttattaccccaaaaggaaacccctacccaattaagcagtcactcaccattccttctaaccctggcaaccactaatctgttctctgtctctgtggatttgcctcttccagacatttggtaaaaacgaaatcatgcaatttgtgtgtctgacttctttcacttagcttaatgttttcagagtccatccatgttatagcatgtatcattactttatagctgaataatattttgttttatggatatatatacaccacattttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccgaggcaggcggatcacctgaggtcaggagttcaagaccagcctggccaacaaggtgaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgttttttttttttttgttttttccccaagttctttatctgcagtaaaagaaaagttgctaatgggtcagttttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacaggtaaacaggagtcagtttatg

SEQ ID NO: 889 - DNA, 155593 bp, mus musculus
cgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttccaagctagcttggacctattacctttctatttttaactgtttctgcaaatattagcatgtgcgagtttggtagtgatcaggtcttcagattcttgtgacgtgaggcttagggttggataaatggctgatttttcattcattgtgaaataagttaaagagttatacagcaggtgtgtagatggcttcttaaattatttgtgtggatttctgtagcgactagaacttacacgagaatttgcaaaatttctagtagaacctgcttaaattaagcatgttattttttggaagttccatagttacaacgttaattgaatttacacggtgcagtttacaggtgtatataattgcttcagattgtcttttagtttaaataagcaagttgtaggtatagattaaatattcatgctttatttttcggggagagaagtatgtgtactgttcttttacctggaaacccatgagtccctaaatctacttaacgtttgtatactttcacttttgaggaagaatgatttggggtgcattgattaggaaactttccagcaggtacttaaccctctcggagctgattacccttaggtaaggactccttaaccatgactagcttggctggttagtacacttgaactcaaaaatagagactataaactctcctttagatctcgctcgtcttctaattcgctgggctgccattttggtttcagcaaataccttcaaattcttgaagaattatgtattaaatataaaaaagtgtcaacattcgttttctcaatttttaaactcatgtgctgtgtcatacatctaactttaaccctttaaactttatcgttccagcttttgggtggagtgaaagcttgaagtatttggaattggtgttccacaggtgaactcaaaatgtctttggtattttactgttttattttctctaatttaaaaataggacgtttggactatatgaattctctctaccccttttcttgtatttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttcaccgtgttagccaggatggcctcgatctcctgacctcgtgatccgcccgtgtcgacctcccagttctcatgttttatctatggaatgctcaagtaggatttactttagatcttttttcttccagagtcttgtttttaatatcttaaggtatgagatttctttgctatcttctcagagatttttctttgacatggtggtaataatgcagcttatggttttgaaatggatgtttgtcatgaatttgctaatcatccagttcttgattagttggtcacacaacaagtgtctttgagcttatttttatttaataagatcaatttctaacgttttagtttcaaaattttagtattaaaaccaatctttgtttaaaacagatgttaagaattagttatttgaaatatctagcagtgtgtgttaatggattagtgttcttctaagtcttttgggcagtgaaggtgaggggggtcttatcctgagattgagttagttgatttttattctgaaagaacgtattactttttatggtagcctacattatgtttcccctcttgtaggtatgttttctgagtcttgaattgtttttcttttttttttcaaaaagggaaaaaaccggattttagttgtcatttggttcttttaggagctgtgtttttgaaagccatcctgtgtattgctaagttcttgtattattttaacatagagtttaacgttaatatttgggaaagagttagtgcattggacctcaaccctgactggacatgagaatcacttggcggggttaaaaaacaaccacaacaaaaaaactgatccctgggttccacccccagagactgattaattggtctgatagggagcctgggcaaaggtatattttaaaagcattgtggatgattcttacatgcatttggagttgaaaaccactgggctattgtttttatcatgttgttagaactttcaagtggataaataagaaaatggatttttttctcaattgttttcagttattagcatgattatcatttgagcattaattgtctgtcagcactgttaagcattttccatttattgccttacgatgggtctgaggtctgtcaggttcaaccagtggtgcttcgactactgtgctatgttagtgaaatgacactgattgctatttttaaaaaagcatttagagcttttggtttgtttctcgtaccagagtaagttaagatatagtttagtttttaagactatcaagatagtctccaatttgataaatatcttggttgcccaagggagatgttaaaagctatgtggcaaataggtttctccccttccatatatcttccagcgtgctcagggtgatagtttagttggtgcgtttatgacaaaatattacacaacattcctaaaaggtgtagaaactatgcatttgtctcctagtaatttatttaaatgatcccacaaattaccgtttagtgtcacatgaaattctgttatctcagtttgagaatttagagttttatttgtcttagtcaaaatcagtttgattttgattaagcgttttgaattttgtgttgttttgggattgatgtataattgttttatggaacgaatgaaataacaataacagacatttatttggagtttctgtctcttaatccccttggtccattggaccaaattctgcatggtgggggcatggcagcagggaagcctataggagtttaggatctatgagggttttttttttttttttttttttttttttgagacagattctcactctgtcactgaggctggagtggtcacggttcactgcagcctccacctctcctgggctcaggtgatcctctccccttagtctcctgagtagccgggactacaggtgctcccatgcctggctatttgtattttttttctcttttatagagatgggttttgccttgttgcctaagctggtcttgaactgctgggctcaagctgtctgcctacctgggcctcccgaagtgttaggattcccggcatgagcgactgggcccggccctatgagcattcttagtgtgacacaagattccccaaagatctttttgttaaattatagaaaatgagactataaggatcatgaaaaaagttgatgtaataaggaaaaagacttaaaacttctaacacttacctatattgggcattgaatttataatttattgtggattataaagtgatgaccattgtaatatacttttaaagaataacttgtgaaaaagtatattgttaggatgagatcgcttacctaaaatttattcttcaaagatactcatgctaaatcttggtgtcttcaacgtgtgtatacacacatatcttatatttggcagcaaatggattttcaattttattctcaatcactgcctaacaaggattttctaccacctctgtgtatcaatcatctgtggagctttttcaaaatatatatttgctctataggtgagtctgatgtgtaaccagaggtttttttttgcagtcccttttagggaaaggggagaattgagaccctttgcatgtcatgtgttccaccattaggcagcagtactcttgtttgagtttcgttttgttagtcacacagtcaaaaattccagactgaaacacaaacatgtagtgaaaagctcaaacactagaagagacagggattccacactcacatgtattatatacagtatatgtgcacatatatatcaaatttattgtcacttagcaccttctcggtgttacggttccagctctactataaacattaatatctgttaagacatttgtttcctttttaatccgttcaacaaatacttctggggcatctgctgtgtgctaggcactgttctagagattactgttgtctagaagctaacatatgaagtgaggtgggctggactagctgatctctaaagtctttagtgctagttttctggcattcttttatgtacctcgtaggagagattggattaagttgttatttaaaaaaactttgttatggtatatgccaattgaattttttttgtcactaaatagaatttcattctgaactccagttttctccagtgagcccaaatgtcaagtatagtagaaataggttcttttggaattcttggcatactggctttaggaatagctgtacttctgatgctgttaatttttgaccagaaattacatactctggtgtcaccccttactcctgccattcctttgctgtattgatgctctattatctctatacagtgtgtttttctatttaatttactttgtttaggtgttttgattaattttgtcctcacaattctatctttaaggttagtggctttcattctaagtcagtgataatatccttagcacctagaaagtgcctggcatatagacatttagtaactgttggatgaatatagtttatcacattcttgctattttacttattttttgctaaatctttttacttctgggagtcacttttcttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaacttgcagtacctccaacctcttgtacagaattgattcatcttcattttatggcaccctacagtttattcttattaatcatgtgagctttgaacaccatgttagtcaaccataatcaaaggaattgttttccttgggatgagtttgagctggtgatcgtgcatattagatcccatcttctacagagcctgtgaattgggtggaaaggaaaaagggagtggcgaagcctcctgttagtatccttgatgtccattttattcctgctgactttggtggctattgagagttataagttgaggctgttggttacatctctcatttctagtcttttctgttaactggttacttagaactcctaagtaaggccgctcattattaacttggaccccagagagcatggaagttaccgtatagtattgaacccatttctgcctaacagtgttttctctctggtcgaggtgtagtgtacaaagttttggttgctctgcttggtaacatctctggagttcagagcacagggatcagtaaactttttctgtaaagggccacatagtaaatactttggactttgtgggctaagaggcaaaattgaggacattgggtaaaatttttattggtgaaataaaaaatataattaaatacagttatgtataacttaggtctaatgagaaaaacaatttggtgtgtgtgtgtggaggggaggtaatacagtattttgctttattgggtaaagttcagtgttccctgtcatcaaattgattgcagacgttctgtgtgaaatccattcttaccttgtgagctgtacaaaaacaggaggctggaattggtctgttaccatagtttgccagcccctagttaagagcagtgatttttttttttaagaggaggggtctcgctgtcactcaggctggattgtggtgacgcaatcatagctcattgtagcctggaattcctgggttcaaggcatcctcgcacctcagcctgccgagtaagtaggaccacaggccgacatcacctcacctggttaatttttgttagagaacaggggtttgactgtgtttcccaggctggtctcaaactcctggcctcaagcaatcctcctgttttggcctcccagtgttgctgggattataggcctgagccactgtgcttgacctcctatttgatacactatatgttaacaactctgaacctcctttccttaagtcaggttcaaacttctgtacattagctgatgaaagggatttctttttattgcaaggtggtattgcctgagaatagtttggtttcagcagctttgctgtatttgtacggcagtatcttgtgtttatgtgcaagttcagatgtattttgcctttttataagaatgagcagaaaacaaaaaagtaaatggcgcgatctcggctcaccacaacctccgcctcctgggttcaagtgattctcctgcctcggcctcctgagtagctgggattacaggcatgcgccaccacacccagctaattttgtatttttaatagagttggggtttctccatgttggtcaggctgtcttgaactcccgacctcaggtgatccgcctgcctcggcttcccaaagtgctgggattacaggcatgagccatcatgcctggcctacctggaggtcttaaatatccttgagacagagggaactggttagggatatgaatcttaaaccttactggattaggttgtgctcattggttaggttagttggctttgtgcaaatagtgaatgcaataattagaatgaaataggaattaagtgaggcaaatgtatgatgaagtttacatttgaaaggtgagggtataattagaaataaaagtttctgtactctgtgagtgggaaaaacccctaaaaaggtgactgtcgtttttgaaatttttgacttctctcacattttcgggaatgtgaaaggaggatactggctatgtacagcatttgtccagacttttgaaaatatagaaaatctcatttactcatttaattagtgtgtatattatctgtttactgtgtcctttgtagatataattaattatccaggattcttaagagttgacttggagcatgctgagctgaggcaagagggattgtggggccagactgagtgttggaggaggaacctactgtagtgactacaggtgtatttcttttttctttttttttgaaatggagtttcactcttgttgcccaggctacagtacaatggcgtgatctcggctcactgcaacctccgcctcctgggttcaagtgattctccagcctcaacctcctgagtagctgggattacaggtgggtgccactatacccggctaattttgtatttttagtagagatggggtttcaccatgttggccaggctggtctcgaactcctgacctcaggtgatccacctgcctcatcctcccagagtgctgggattacaggtgtgagccaccgtgcctggtgtgtttcttgtctgatgtcagtgcatgtcgttatctgagccatatcaatgtcagctgaggattgctttgttatcctcggtgcattatgggaaggagaatcatgtcagtgctaccttactgtgattgaattgaattcattgatttaatatagattcagttagtacgccttatccataatatttgggatcagaagtgtttccgattttgtaattttttccccatattttggaatatttggaatattacttgcgggtgagtgaaaattcaaaatccgaaatttggggccaggcgcggtggctcacccctgtaatcccagcactttgggaggctgaggcgggcagatcacttgaggtcaggagttcgagaccagcctggccaacatggtgagacccccgtctctactaaaaatatgaaaattagccaggcatggtggtgtgcacctgtaatcccagctactcaggaggctgaggctggagaatcccttgaacccaggaggtggaggttgcagtgagcccagatcgcggtactgcactccgtctagcctgggtgacagagcgagactccgtctcaaaaaaaaaaaaaaaagttcagattttggagcattttggattccagatttttcagataagggatgctcaacctgtgccattttaggcaccagagggtatataaagatgattctctgctttcaaggctctgaagtatggtgaaccagacagttatacagtgcaattacagctgtattaagtggaggtgtgaaaagtgtagtaggagagatggagaaatcattgtttggcattgggtgaggtcttcaaagatgtcctattttcatggccctattaattagagcagggacttccggtcagagggatcaacttgagatcaggcagggttttttaaccctattgacagtttggggcagataagtctttgttgtgaggtgctgtcctactcagccctggcttctacccacaagatgccagtggtatagcccctaccccactcatatgtcttcagacattgccagttgtgccctgggggcaaaattgagaaccattatttgaaatggagcaatgcaagtgtgaaagtatagtgttttcagagtaagaactagtaggagagtgtgcaaggaacactagagatactgggaggggaggggttatgggagatggaactgaaaggtagtttgagtgaagctaaaatcacaaggggtaaccttgagtgccatgttaggacatttgccttttactgttaaggtaatgagagatgtactttgaagtttaagtgaaaggagacattagatttgtgtttgtttttgaaagataattctgatggcattcgtggcagatgtgttggagagttgagtgtcgggggattgagatggtattttaaccgttcttctgaaagataagaaataatgattagggaatggaataaaggaaggagatcaatggggtgctcccatggtatgagggaggtgctgctaatttgagtttggcttttctgccacagaatggagtactgagctaaaaagcaaaacacctctattgtcttcctttcaacttttcctgccacctccaattccctttcctcactgagagctgctgtctgttgaggtctgttgaaaggtcattgagagaagggaatctgggttacagaatgactactctctcaatgtggttccttaaacagtggattatcaaagcacaagtgtcatcttcccccccgctccccgcaaggggttagactggcatccagagagcattaattgtagcctctccttggtttgtgtagatgttattttgccctaaaatactttgatatacaaacataggtgaataatctgatggtttaattgtaattatttcattgcttcctattttggaggttagctttactattttaagtgagaatgtagtcagtggaagggtactggacttggagtcacaagatctgtgttttatttttttattttattgattttttgagacagagtctcgctctgccgcccaggctggagtgtagtggtgtgatctcagctcagtgcaacgtctgcctcctgggtttaagtgattctgctgcctctgcctctcaagtagcttaggattacaggcaccaccacccacggcgaatttttgtattttttgtagagatgggattttactatgttggccaggctggtctcaaactcctgacctcagctgatcagcctgccttggtcccccaaagtggtggaattacaggcatgagccaccgcgcctggtcaagagctgtgctttagttccagttacccaactccctgtgttaaatcacttagctaacctcttgggtcttcatgactctgtaaaaccaagatgttgggcaagaggtgagttaaactactacttttttaagttcttaaattttatctttattcctaaagatgtggaaaaatctgtagtcaagagaaattgtcaagtaaaggaaaacagagaaggtaaacactttaatgggtttagaagttggttatattcctccatttacttgtcaatccaacaacttgaatgtctcctctcccttgtttctcctgtgtggtctgaagggctttattttatttagaatcctgtgggttaattgtgcttggcccacagcttgtactgtgaatttagggaccatagactttgtagccaggggtataatttctttgttggcagagcaacttaaagtttggttaagttttcatctgcagtctagtgctttaataacataacttgctaaaaagtgatatagcctgctaggggaaatagtatttagggggaaattattttttccgaattgaagatgaaaatacacagataaatacagtaatagtgatttttatctggcacagatggtttcagagaaaatgttgatacctcatttcttattttactgtaagagaactagcaaaagaagcttattttgtttcttaggtgagtcattctcaaacttggtctcaggatgcttttatactcttaaattattgaggatcccagagagcttttgtttatgtggggttacagccattgatgatttactgtattagaaatgaaaacagacatttaataaagttatgtatgcttttaaaagtaacaaaaccccactgcatgtcaattagatatttttatgaaaaataacttttccagaacaaaaattagaagagaggcattgttttacatgttttacaaatctcctatctggcttaatagaagacaactggattctctgcctccttctgccttcaatctattgcgatataatacgtcatatagcctttggaagaactccatagtacacttgagaaagaatgacagtgaaaatggcaagtaaagtcttaagaaaacaattttgacctctctgacctcttgaaaagatctcagggatctttgagaaccagtgtcttagactgccaagagaagatgtgatgttatcttttgagtggcttatctactgtaaattttattttaactgagatatataacttacagtaaaatgcacaaatatgagattgtatagcttgataaatttttagaaaatatatacatctgtgtagtcattcagatcaagatacagaatatttccagcaccctggaaggttcccttatgcctctacctcctccctgtaaaaccccaaataccctgacctcttttttttttttttttcttgagatggagtctcgctctgttgcccaggctggagtgcagtggtgtgatcttggctcactgcagcctccatctcctgggttcaagcgattctcctgcctcagcctcccgagtagctggaattacaggcacacaccaccacacctggctaattttgtatttttagtagagatggagtttggccatgttggccaggctggtctcgaactgctgacctcaagtgatctgtccacctcggcctcccaaagtgcagggattacaggcgtgagccaccgtgcccagcctgacctctgtcttttaatgaatgttatgcctatttttgaacttcggataaatggagtaatacactatatactcctgtatctggctgctgttgctcaatacatgatcactaactgtctttttctttattgtttttttgagatggagtcttgctctgttgcccaggctggagtgcagtggcgagcttggctaactgcaacgtccgcctcccaggttcaagtgattctcttgtttcagcctcccgagtagctgggattacaggcgcctgccaccacacccggctaatttttgtgtttttagtagagatggggtttcgccacattggccaggctggtctcgaactgctgactgcctgcctcagcctcccaaagtgctgggattacaggtgtgagccaccgtgcccagccaacttcgtctttttcattactgtatagtattgtattaaatccatgatttatttatccattctgttggattgaggtgggtttttttcatttgtttgttttgaaacagggtcttgctctatcactcaggctggagtgcagtggtgtgatcacagctcagtgcagccttgtccttccaggctctagcgattcctcccacctctgcctcttgagtagctgggaccacgaccacatgccataatgcccagataattgttttttttttttttttttttttttttaaacagagatggagtctcactatgttgctcaggctggtctcgagctcctgggctccagcaatcctcctgcctcagcctcccagagtgctgggattacaggtgtgagccactgtgtctggctgacgtttgagattgttcagtgttttcaccaatataaagaatgttgccatgaacacttttgtatatgtcttttggtggtcttttgctgcatatccaggattggaattgctggtttataggatacatatgtgtttagctttagtcaatactgccaaacagatttcccaagtagttgtaccagtttaaactcctactagcagtaggtcgtgttgctcttccttatcaatacttagtattattatcagtcagtgtttctaattttagccctcttggtggaagtttaggaatatctggtggcttaaatttgtatttgtgtctagtgtttagaatactttcacatgctcaccagtcattttactatttaactcttgcttacctataaaatttgaagcttggctaataacatcttgtgtagttcaaaatcactagttgaatgaattttctgaaatgaggcttttaaaaataaacttaattggctggtcatggtggctcacacctgtaatcccagcactttgggaggccaaggcaggtggatcacgaggtcaggagatcgagaccatcctgaccaacataatgaaaccctgttgctactaaaaatacaaaaattagctaggcttggtggcatatgcttgtaatcccttttctgagaagtctttaatagatactctctaccctcttctaatttactccctttccaagctttttattaaggaaaaatcaaacatacacagatgtagataaacttccatttgcccatcaatcagcttcaactcatggctagtcttttttacctacccccttccattttgatgcaaaacccagacagcatttcatcttacatatttcagtatatcccattctaatttagatgtttttttccttggtgctcatattgtgctgctctattgtaaattataagttcaatttagttcttacatattctctcattctgctttgtaaacttctcacaggtaacaatcactaacacttaacacctgtgtgtgaggatctatgaaattgcttcacctgcataaattctttatattcttacaacagctctaaaaggtagatattactgtctctgttgtatatataaggaaaccaaggcacagaggttgaataacttgtccagcttgtacacctagttaagtggtagaacaggaattcaaactaaggcagtttatcttcagtctttagtgttaactactgcattacataatgtctgagtaaatgagcgctctactgcatataagttccttcaatcgtcctttttaattagcattttttccttgttaattttgcctcctgtcttgcatttccaacggcacacaagtattatttgctctttcataaaatctagctaaaagggcccttagcatgcaactctcttattttttatttatttaaaaaaaattttttttgaaatggagttttgctcttgtcacctgagctggagtgcaatggcgtgatctcagctcactgcaacctctgcctcctgggttcaagcaattctcctacctcagcctcctcagtagctgggattactggtgcccaccaccacgcccagctaatttttgtatttttagtagagatggggtttcaccatgttggccaggcaggtctcgaactcctgacctcaggtgatccacccgcctcagcctcccaaagtgctgggattgcagatgtggccacctctcctgttttaaagatgatcatcccttgcttttagctgttctgcttctaattttatatgtgatattctatcaaaaaattgctgacctctggtctttttgtttaataatagtgtctctataattatggggagaaggtaccacatactgaatttaaatattttcgtcttttatatactatattttaaatttttaatgtttttatttttgctttaacattgtatttgaaaatttcatttgcagtaactcgatacagctttcactttagatttttctgttttgagtattagcccttccggtgttaatttgagtgttcgaatctttaggattaattgtgcaaagatataaagactttagagaagccagccaggcacggtggctcacacctgtaatttcagcactttgggaggcttaggcgggtggatcacgaggtcaggagttcgagagcagcctggccaatatggtgaaacccagtctctaccaaaaatacaaaaaaaaaaaaaattagccgggtgtggtggcacatgcccgtagtcccaggtacttaggaggctgaggtaggagaattgcttggacccgggaggttggctcactgcaacctccacctcctgggttcaaacagtctccctgcttcagcctccctagtagctgggattataggcgcccgccaccacgcctatagcaaagatcgcactactgcactccagcctgggcgactgagcaagactccgtctcaaaaaaaataaattaaaaaaaataaataaataatgactttagaggatacttcttctcagatctttcttagtggaatttgtgtatgtaaaactattacagaaacaacccaaatgtccattgtccatcaagtgatgaatgcataaataaaatatacaatggaatattatctgtcaatgaaaagaaatgaagtactgatacatgctacaacttggatgaactttgaaaatgttatgcttaagtgaaataaaccagtcacaaaagacctcatatcacatgatgccatttatatgaaaatagattagcatgggactgaggggaggttggagggaagggagaatgctattaatggtatgaagtttctttttgggggtgatgaaaaagtaatctgagatcgattttggtgataattgtgcaactctgaatatactgagaacctttgacttgtacactttaaatggacgatttgtatggtatgtgaattagatctcaagggtgttattttaaaaaacttaaatataatttataatgataatctcattgattaaacataatttgaaattttttggtgtactttttcagattctttacatttatgatttaaccaatctggttttggaagatacaggcagaaagaacacccagtggaggcacataaaaaatgttactagactgggtgcagtggctcatgcctgtaatcccagcactttgggaggtggaggtgggcggatcacttgaggtcaggagttcaagaccagcctggccaacatagggaaaacctgtctctactaaaaatacaaaaaattaattagctgagtgtggtggcacacacctgtaatcccagcaacttgagagggtgaggcacgagaattgcttgagcccaggaggtggaggttgcagtgagttgagatcacgccgctggactcaagtctgggcgacagaacgagactgtctcaaaaaaaagaaaaagttaattattaatactgccttgtctaaaatgtcataaatgaaatgagatctttcttttcagtgtattgggttagcatttcatgattgggttagtaacttagaaaagttagataattttgtcaaaaattggtaaaaagctgttaacagataactttgagtttatcttttttttttttgagacggagtcttgctctctcacccaggctggagtgcagtggtgcaatcttggctcactgcaacctccacctcctgggttcaaacaatctccctgcttcaacttccctagtagctgggattataggcgcccgccaccacgcccggctaattgttgtattttttagtagagacagggtttcgccatattggccaggctagtcttgaactcctgacctcaggtgatccgcctgccttggcctcccaaagtgctgggattacaggcttgagccaccacgcccggcctaactttgagtttatcttaacctgttgtttcaacagagtagattgatagttaggcatacccgcattctgtaacatttgatgtgacttatgtctaatattaagtcaacattgctcacctattggctgatttagggactgggatttgtcggaacttcacagcctttgtaacgatttaaaaaaggagttaagaaaggtgttttctttttaaaataagtcttttcgttttgatgatatttttcaacattagtacatgcatttttggattatccagatgactgcctcataatcaagaactgttaacatcatttcggtacttatgttagcttaataatgtgttggtgccaagggcaaatgatgtcacaggatactatgtgtatagagtagtgtaatcattcaggtagaagtaggaacatatgatggtggtatagccatgcaaaactcgaacccatgccttagcattcagtaatacactgccatctgtcacgttatattaatagttttatttgtattccatttataaatttattttagttttagttatgagagcagtaagcataaggaatttaatcctaatttcatttctgcatttatttaagcaacattaaaatagaaagtgattaaattagtttttaaaaattctgttatgatagaaccagaatttgcaagcttgagccagcttacttaatattattgctggaaacctagcatttggcattaggtgactggaactgggactgcagttttgtatttactaggttatttctctatttatgaaatgggaaatatatttctaactaaaagggtcgttcatttgttcattctttcactcaacagataattagttgtgtagcaccacataattttatctcattactagtttaattttccctactgtcaaattttcttcagagccagcacaaaatctgataggaatattatgctatgaattgtcttctagaaggtaagataccacccccactcccccttttttgagacaggttctcgctctgtcacccaggctgaagtgcagtggcgtgatcatggctcactatagccttgaactcccaggcttaagccatcctcctgtctcagcactcccagtagttgggactacaggtgcatgctaccacgctgagctaatttttgtattttttgtagagaaggattttgccatattgcccaggctggtgtgctgggcaattcctgggctcaagtgatctgcccacctcggcctcccaaagtgttgggattacaggtgtgagccacttcacacggcctatacctttaacttgaaatttactttttaaaaaataggacaaaataattttaaaatgtggtaggattctgttgtaatgcaatggaataacagctatatcagtaaaactgttgaggctgttcatttatttaaaaacctaagcaattgtggtgtgtataccaggagcagcaaattctgataatttatagttgggagaataattttcctctgggctggtctagagattatatttatagggaccctctgaagattcaaaaataagaattgtcaagaggggataatcagcatttcaagagaggaataaccagcacttgttaaaacacctgctctttactgggtccctctgtgtgtctggtacttcacatacattctcctattaaagcttttcaacagtctctggaggtattagccatcttgagagagaaaaaaaaaagatacctggagttagaacatcatctgttgtcggcctgtctgctatgttgcagtatatgcattgttgaaaacctcatagtctgcaaaaatcaggtaccaaaaactaacaatgtgtatagggaaaaatgggcttaagagtaaactgatcacttcaaagctatgttactttgtaattagagcactaacaaaacaataaaaattccagtaaaatagcacagttttgaagatcctaaatttctgacaaactacaataaatataggacttgaaaaaggtagcttgatggaaggggcaggtataagggggagggttggggtgactgacttagagagacaaagctaagatgcataaatatcaggtggaactgcgtacatacttctgagacagagcatgtggcctgactaagccaagaagaataatgtggggctaggaggtggtggtgatgagcatctggttcagacctataacccccaaccccatgctgcattcagcttctgttacttgtgggtacaaaacatcaatgtgttgggggaaaagtggcaaccactattctactttgtgaatttgacgactccaggtacctcataagtggaatcataaaatatttgtccttttgtgaccgctttatttcagttaacatagtgccctcaaggttcatccatattgtagcatgtcaaaatttccttgctttctaaagctggattattttccattgtttgtatgtatattttattgacacattcatctgtcaaacggatacatatgcttccacattttggctattgtgactaatgccgctatgaacatgggtgtacaagtatttgttcaagtccctttcagttcttttgagtgtatacccagaagtggaattgctgtatgtatcatatgtaaattctgtgtttaactttttgaggaatcaccatatgttttccacagtggctgcaccattttacatttcttccagcaatgcacaggggttccagtttctccccttatccttgctatcacttgtgttttctgcctttttgattatagccatcctagtgatatctcatagtggttttggtttgcatttccctgatggctaataatgttgagtatcttttcatatgcttattgaccatttgtatgtcttacacattcagatcctttgcccatttttcaattgagttgtctttttattattattgagttgtatgaattctttgtatattctagatacaagtcccttactggatacattatttgtaaatgtttttcttgtaatttgtgggctgtgggttgtcttctcactgtttacagtgttcttcggagcacagaaattttaaaattttgataaagtcccatttaactatttcttttgttgctcctgcttttggtattgtatctgttagaatccattgccaaatcctaggtcattaagatttaccctcatgtttcattctaagagttctatagtttttttatcttatatttaggtctttgatgcatttcatgttaattcatgttgttactgggaaacacttctatatgtagtaggctcaacaatgaattatacacatgttgtgttacacaatgcattttaagtcagttaagagaaagaaatatgcagtcatactgttttcttataattgcataattgtatttaccagtgttatttcactgagtttgtgtcttgtcatgctcctccggttgtcatactggaagtatatttctgaattaatttttttttttttttttttttttttttagacagagtcttgctctgtcactcaggctggagtgcaatggcgcgatcttggctcactgcaacctccacctcctgggttcaagcacttctcctgcctcaacctccaagtagctgagattacaggtgcctgccaccacgcccagctacttttttgtatttttagtagagatggggttttgccatgttggctaggctggtctcaaattcctgacctcaggtgatccaccagtctcggcctcccaaagtgctgggattacaggcgtgagccactgcacccggccctgaattcatttttgaaataaatttggttgatagttttctttctttcttttcttttctttttttttttttttttgagacagagtcttgttctgttgcccaggctggagtgcagtggtgtgatctcggctcactgcaacctctgccgcctgggttcaagtgattctcctgcctcagcctcccaagcagctgagattacaggcgcccgccaccatgcctggttaagttttgtatttttagtagagatgggtttcacaatgttggccaggctggtcttgaactcctgacctcgtgatccacccgccctggcctcccaaagtgctgggattacagacgtgagccactgcgcctggccaatttttgtatttttagtaaggatgaggtttcaccatgttgaccaggctggtctcgaacttctgacctcaggtgagccacctgccttggcctcccaaagtgctgggattacaggcgtgagccactgcgcttggcacgatagttttatttctttcagtgcttgaagaatgccatcccactgccttctggccttcaagttttctggtgagaaatcagctgttggtcttactgatgatcctttgtatgtggtgatggatgcactttttgctgcattcaagattgtctttgtatttggcttttgacagttgatgatgtttctcagtctggatcttgaatttatcctacttggaatttgtcgaacttcctgcgtgtgtagattaatggttttcattaaatttggaggcagtttttgattctgatttcttcaaatgtcttttctgttcccttttctcccgtttctggggctctcattatgcatatgttggtttgcttattttgtcacacatttctctgaggctctgttcattttttttctctgttattcagattgcttaatctaacagtctgtatctttgctgattctttgttccgacagctcattggctgaatttttcgtttcagttattgtacttttcaacaccagaatttccgtttggttctttttgttgttaaattctgttagtctctgtttgtttagaaattgtcatattttacttctttaagcatggtttcctttagttcattgaacataagcataagagctgtttttgaggtctctgctaagtctggaccttctcaaagtcagtttcttttgcctactttttttctgtatgtggggcacacattcttctgtgcatgtcttaaatttttttgtttaaaactggaccttttatataatatagcaactttggataccctacacctctagcagctttgttgtttgttgcttccttatttatgtagtgactggctgaactattttagtgcctacccctcagcctgtgatgttgctcttcagcgggtgtagccttagtcatgcctgggatgatggtgattttagcaaggctttgtgagtttctgtgatctctctgttaaacctctctctgtgttggtatcacatgcacatattagcctctactaattgcctactgattggtctgttgatttaaatgactccttgggacataaattgccccacagtctgatccagttaaattctcatgctttccaggggtaagtaatctttgaggctgtgtctgaggtttgttctgaccccaggaaggttcttagcttttatttccctggttctatctggtaagctgctagctgagtagtttaacttgttgctgtccaccacaggtcttttgatagctgcttattaccatgatctctcctgttttgtgttgttttccaacacaccctcaggcagcatattaccatattgtttcaaatagttcactttaagacaacttcagaactctgttcttacggcctgcctttccccctgggcaaaatctttacaccactgcttcagaactgggttggactgtggctcacttctcagagtgacacctctgcttcttgagcagggtgattggctttgcctgccatggaatcttgactctgagtgaggtggggtgggggccattaggaccacgcttttcttgacttgctgcacctggggttaagagcgtctgcctcacaagtggggcctagctggaaaaaagagccccagacttcttagccactcttggtgcaatagagcctgtgcaactcaaagttgggggtgttgagaaatgctgcctgcctttacctcctggggagataccatcaactgggagctgggtcgggggaggtgtgttcttggccgttctcacctggagtggagctactgtcctgctgagctggctcaaatgccacagactatccttactgagatatggtagattttcttaaataaattattttttcatttggtatatgcccttaggacaatttccagaggcttttagtgttttttgttttttaaaaaaataattttcaccagttaacgattgtttcactggggagagcatttacggagcctttgagggcaccattccaaaagttatttttaatgtaaaattactcaaattgcctacagccacttaaaaatttgtgtttgagaatgctttggaaaagatgctgaagtttatatgtatgtaaaagcttcattactctaattgtgtacgtacaacttgacagatgctcgatatggaggaggtttgaataagggtgtttggccaattactgagcatttctaaaagaatacatttctgctgccacaaagaattttgaatgcaggatgcagttctgttgcagtgacttataggaagtagccatggatgtacacagtaatttagtgacaaaaatcaggaatctgtaaggggtgtgtatgtgtgtgtgaatagtgttggaaataaaatacgagcatttagctcaagtaacatatttgaatttaacaaagattaattggacatctttatttgcattaacctgaattattgattggatttaaagctgtctagaagtagcatcacactggggatggggggggcaggaaacctgtgcttaatacagttatcttgactggctttgggtataatttatcataatgtgtgataagaatgataaagtctgtgcaaatgataatggcagtgctggtggaactaggaaaagaaaagcttttacctttgagcaaaggccacattttaaaataacttagggatgtttaggtgtatagctgtgggctcaactattaaaaataacttactgtatttcagactccttaacatgaacctcctcatttaacacactctgtcagagggagagatccccagacttctcagccactcctgcctgtttgagaaggattctcaaacaccccctcccccagagaaggggcctcattttgttgcccaggctggcctcaaactcctgggctcaagtgatcttcctgtctcagcctccggagtagctggggctataggtgtgcaccaccacagccagctaatttttataacatgattttttattccatatatctgaggaatacagctaattgtgtcttagttccttgatatgtactataacagtgacaacgatacttaacatgcagaaattgtgaattaagtgaaaaatccaattttgtaaaacatgtttctgcatcaaaaactaaacagtttgtcttgggagtggggttatggtgagattaatggtagtttccccctcccttttctgacattattgatgtatggtgtgatagttaaaactgtaggacactggcacttgtactgtctgagtttgaatcctggctcctaccactttgacagcctgtagtcctctgtcccagtttttttactcatgaaattgggctgataatagggttgttctaaggattaacttgcttagaatagtgcctgagacaaatacttaaatgttagctattgtcactattaatgaggaaaatgttatttaaaatttgaggtgtgtcaacctggctgcactagtattgaagttgggaaatgagagacaaagttggaaaaataagttaaaggctgattatgaatgaccttgaatatgtaccagatggagaagagaagccattcaaggttttagagattgaaagtgttgagattaatttagcattaatatactgaacgattggtatggtagtgtggacgctagccaggatgctgttaaaataggagtctaggctagagtggtttgagtgggagtggaaaagataacattggacacatcatgaaagaagaatggaggagatgggaagggagagatttgactttgtttttactgtatttccccacactcccaattttagttttgagcactgctatagactgaacgtttgtctccacccctccacctcgcaaattcatatgttgaaacctaaccctcatgtgatgaggtggggcctttgggaggtgattgggtcacgagagtggaaccttcacaaatgggattagtgcccttgtattaataaaagagactccagggagttccctcactctttctgccttgtgaagatacagtaagaagattgctatctgtaaaccagaacgcaggccttcaccagacgctaaatatgcttggcaccttgatcttagactccccagcctccagaactgttaagtgttacttgagccactcactctgagcttttgttacagaaggggctaagacaaacaaacacctgttgtttgccaatgaatccttgggattcagtgatgagcaaagcttgcatagcttctgcccttaaggagcttttatgttttagtaagaagataaactcacacaggtgctatgagaaaatagggtagctggctcctagagtctaggatgtgagtacttgatgaatcctgagtcaggagagttgggagctgctgaattaatatgggtaaaactaagcagactgctttgttcagaggctctcagaggtggcatgaaggagcactttgtgaaggaacaacaagaaggcaaattgaactggagtttgaacaagctttggctggggttagctgcaagatgaggctggaattgggtgtttgagggccttgtagaccattagataagtattttgatcttcatcctggtctttgaagattttttttttttttttttgagacggagtttcactcttgttgcccaggctggagtgcggtggcacaatcttggctcactgcaacctccacgtcccgggttcaagcagttctcctgcctcagcctccctagtagctgggactacaggcatgcaccaccatgcccggctaattttgtatttttagtagagatggggtttctccacgttggtcaggctggtctcgaactcccgacctcaggtgatctgcctgccttggcctcccaaagtgctgggattacaggcgtcagccactgcgcccagccagtctttgaagatttttaagcagtgctgtgacatattttgcatttcagtaaaactcatagtgatgatttttaataccgaaagaacaaaacaattgtaggaatggatgcaggcctgacagtcactgctttcaaaagaaagctcaatcccttttccctgttgtttccttttctccccgtttgaatttatagagaacaacagattctgtagagaaccttcatggtatagttggaagagccaagggttttagagtcttaacggaaattattgtgatcttgtataagctcagtgtacttaatctcttagcttctatttatgtctgttaaattggactgatggctgtatgagataggtattatgattaaatgagattatacaaataaagcacctactgttgtgcttgatacacaagtaagtacttaaaacttttcaagaataatatacaaactaagaactggaaaggagccacagagaacttttgaatggaatggaaccaacaagtccacaaaagaaaaaaaatctttagcataaatactgagacctgtttcgccttgcccacagggtggttatggaccatagtgtctaaatataattgattgtgaggtgtatgctacaagtaattataagcaattaaataattagttaaaatagtaatgtttgcaaatgagattacctaaaaatattagagtcaagattatccccttaataattattttcactcacatttcatgtgttttcgattgaggcaccaaaagaatccttgaagtccagcatataagctattaatgtttgctgtttttattttgtgctctgctttatacagtttttgttttttggcaatttctctgtgtccatagaagtgtgtcaaacctgtgataaccttattttagtgtcctttctcatgctgtggtagaaaaactgctgtgtaggttactttttcttctagacaacaatgcactaaaattttgtctttaaaaacataattgaatctgtcatagcaacagcatgttcaatttaaaaattcaaaaagatctaaacttggcttaaaaatacgtttttttgttgttgtttttatttgagatggagtctcgctctgtcgcccgggctggagtgtagtggtgcgatcttgctctctgcaagctctgcctcctgggttcacaccattctcctgcctcagcctcccgagtagctgggacttcaggcacctgccaccatgcccgactaattttttgtatttttagtagagacagggtttcaccgtgttagccaggatggtctccaactcccgatttgtgatctgcccgcctcggcctcccaaagtgctggggttacaggcatgagccaccgcgcctggccaaaaataagtatttttgtactctaaaatggtgggcattttgaaagaaagcttagctgaaaagatgctgcttactggattgtaataaacatgaaacaattgatttatacattcacattataattttaaatcagtatatagttgacccttgaacaacatgggttcaaactgtgtggtccactttcactgcagatttttttcaataaatatattggaaaatattttggagatttgtgacaatttgaaaaaaacaggataaactgcatagcttggaaatactgaaaaaattaagaaaggtgtgtcatgaacgcgtaaaatacatgtagataataatctatttactaccataaaatatacataaatctattataaatttaacatttatcaaaacttaatgcacacaaacgtttttatagaccacatgtggtgccacgtgcagttgagagaaatgtgaacaaatgtaaagatggattaagtcataactgcataaaattaactagtacattctctactactgtaatttcatagccatctccttttgctactgcgatgagtttgttgtaagtatccgatgaaaatatgtgacgctgatctctgcatgagcagttcatctctccagtaaatggtctatcatagtaaaaaatgatctctcatgttctcatgtatttttcatcatgtttagtgcaataccataaaccttgaataacattacgggactcatgaagtgtcactagtggtgctggcgaacaggctcccaagaagcagagaaaagtcatgacgttataatgttctgcaaagtttcttataagaaaaagttgaattgcttgataggtaccatagattgaggtctgaggtctgcagctgtggttgtccgccatttcagatgattgatcttgtaaacagatgatgtaattttactttattggtaaaaacagtacagtactataaatacattttctgattttcttctttccttttttttcccttttcttttttttttttttgagactatctcactctgtcacccaggctagagtgcagtggtgcgatcttagctcgctgcaacctccacctcccgagttcaagcgattctctgcctcagcctccctagtagctgggattaaaggtgcacaccatcacacctggctaattttttttgcattttttattagagacggggttttaccatgttggccaggccggtctcaaactcctgacttcaagtgatccgcccgcctcagcctcccaaagtgctgggattacaggtgtgtgagtcaccaccccttctgagtttctttttttctctagcttgctttattgtaagaatacagtattataatacatgtaacaaaatatgttagtcgcctctttatgatcagtaaggcttcttgtcatcagtatgctgttagtagttaagtttctgaggaatcaaaagttatttatgggccgggcgcagtggcttatgcctgtaatcccaacactttgagaggccgaggcgggtggatcacgaggtcaggagttttagaccagcctggccaacatagtgaaaacccatctctactaaaaatacaaaaattagcccggcattgtggcacctgcctgtagtcccagctgcttgggaggctaaggcaggagaatcacttgaaaccaggaggcagaggttgcagtgagccgagattgtgccactgcactctagcctgggcaacagagcaagactccgtctccaaaaaaaaaaaaaagaaaaagaaaaaaaaaaaaagtagtgaggtctggcgccctctactggtgaaggctaagtatagcttgtgttgtacagttaggtctcttgtctctagtgagtcaaatattttaatggaaaaacaagggttatagatgtcggttaaacatagaaatttgaaaggaagagaagtaattccctttgattgttggtgcataaaaccggaataggcaaaattcacaagtcaagattaatttccaagtcaagataatttccatgtttgagcttaaggatgatctatcaaattgttttctaagaaactcatttcactttgatgtccagtaaaggaaataatctggtagggggttggagttgctgttgcttgtttattgtctctatccccagtctgtaatgttccacaaaagcagagatatttgatgcactgtgtacttccatatattctcctatgattagaacaatatgtgacccattgcagatgctcagtacacaatttttgaatgactaagctttgagtttttatttaaacaccttttttttggatgaaaagaaaaattgagagaagaaaatcttaagtatcctaggatcatatgtagaatcagaggatttcaacgtgctgtataaaaggagagagattctggaacatagggcaaattttagcagagttgggataatgactgggtaagaaaggataattctttgttctaaaagggatttctctggtattaaggccctgtgtgaaagctgctggagaaattcagttctgcaaagtttaaagtaaatggtttgctgtttatggagtactagattacttaatgcagtccagcctttatctaggtaaaggtgatgcttttcccattgtggaagatgttaggatgctaagtttgaatatgaaaatgtgttgtgtgttgtagaggcaatcaaatcaccattttggttgtatttcccattgagaaaattaaagatgcttctgtttgtgtaataattttgtttttatgaaataaagcgtaaaacttcatgtggtaaaatttcacactgtgattcattgtatttgagcatgcctatggaaagtgattgttactgtgtcaaatattgaatgatttgaataattactaagttgttcagttgtgtgtaggatactgctgctttgacttggtagagagcttgttctagccctgctaggtatgcctaaatctctgtgacataaaaaacaggctcttttagagttgtgagactgctacttgaaatcaggcaaagctgtgtgattcccagctgtttccaccacttgagtattgaataggatttattaagaaaagtagtggtgttattcttggataacttagttgtatctgtgataagtttttttctcccactcaaacctttccaaattatatctgaaggcaatattttcagattcattcctgaaatatttaggaactctgcacagtacattgtagaaagggaaaagaaaatttacatttttttgagaattactgtgcttgctatttgtgagactccttttattaaagcaattctcatggctttcttttttttgtgtgggtaatagcatctcaattttaaatacctggaaaaagaatgagagaggttgttactttctttttaagataggcagattgtaagtgacagaagttggattttgaatgagttatgtttgaatccagaaattatttttaattgctccatgcctatttcctgctctttatcttgcatcttagtgtgctgagggaaagggatcaaattcttatgtggtagtagagagatgcagcagagtatgctatgctgagacctgacatacctgctcagcaataccggaaatatagaaatgaggacagcttgtcgggtagaagaaacagaaaccaagagctagaaaggcgagactatataagagatagggatagcaagcagcttgaggcttttgctgattgagtgtcctgtcataagcagaagatgatttagttctgtggtcttagagaaaggtgttttgagagaggagtttcacactgccgcttttcccatttatcttagttattttgtttaaagggatagtcccttagttatccacatgatacttttgtctagaataatttataccatgacttttgccagatatttctgatttgtgtatagatggttactgaattcatatagatggaaggatattgtgcataaaaatatgagaatataattttgaggtattttagctcaaatgatctccaaatgctaaaagaactgcaaggtaagggaacagtgagtactctatatatacaattttactgtgggaaaatatacataaaatttaccattctaaccttttttttttcttcttcttttttttttttttttgagacggagttttgctctgttgcccaggctggagtgcagtggtgcgacctcggctcactgcaagctctgcctcctgggttcacgccattctcctgcctcagcctcccgagtagctgggactacaggcgcccgctattgtatgtttattagaggtggggtttcaccgtgttagccaggatggtctcaatctcctgacctcgtgatccgcacaccttggcctccagaagtgctgagattacaggcatgagccaccacgcccggcccttttttcttcttttttgagacggagtctcactctgtcatccaggctggagttcagtggcaccacctcggctcactgcaacctctgccttccggattcaagcgattctcctgccacagccttccgagtagctgggattacaggtgtgcgccaccacgcccagctaatttttgtatttttagcagagacaagtttcaccatgttggtcaggctggtcttgaactcctgatttcaggtgatccacctgcctcagcctcccaaagtgctgggattacaggcgtgaaacaccgtgctcggctgattttaaccatttttaagtttgcagttcagtggcattaagtacattcacattgtgggatgcttaccatcatccatttccagaacttctcttctttccaaactgaagcgctgtaccccttaagcaataactccccatccccccagcccctggcaaccatcattctactttctgtttctgcaagcgtgactaatctgggtacccgtgtacttggaattatgcagtattgttcttttgtgaatgacttatttcacttagcatgatgtcctcaaggttcacccatatcgtagcacctgtcagaatttcctttctttttaaaaaatactaaataatccactgaacataggtaccacattttgttcgtccttgtattgcttcctggaaagacttttaaaagagacacagtattggcttagtagacaaggtgatctccctggccccctacttgccccacacttgggaatatatagtcgctaacctcatcactctcaggaggagatggtagggagtggaggttgtatttattttcgggaaaaaaaacagactcccaggtggtgctgatgaatccatctcttcctacccttttgtgaatagttgaatctgtgttcaagattcccaagttttgcctgaattctagacgtgtagagccaactctctagtggttttcacctcagtttcaatgttaagaactgtacgaactgccactctacccctttccttggaagagaagtggacgggaaacctggagtccaggattatataagccaaggaagctcagagtttcaagaagggagaggtggtcagtgtctaatgatgagaagagggcaaacaggatgaatattgagaagcagttatttgatttgtcagtaagtagaacattgatctgtggaccttcttctcatgcgtcccctaatgcacatactcaaaagctttgtatgtaatttttaggggaattaatcttgaagcccatccctacgtctcgattaagaccttctggcttaaagcagttttagttttagtagctttggatggagccaggtgatgagagagaatggacaaagtggaaggtgagatgggcggggcatggtggctcacatctgtaatcctagcactttgggaggccagggaggagaattgcttgagcccaggatctcgtgaccagcctgggtctcaaaacaacaacaacaaaaaacccaaaatttacaacttacctactttgtcttcatcacatttatttaaaaagaaagagaagggggaaatggagacagtcttacgacttgtgggaaaagggaagggcagacactggtgattttcagtagggaagattcaagcacaggctgggaaaagattgattggggatgatgatgattggagcatcatcccttggagagggtatacaatgggatcatgaccccaagctgagggacaagaaaaagaagaaactggagcagatttgaagtagacaagaataaagttgaattggttagctaatattttgagtgccaagaaaataattattcacatattagccaggtgtggcagcacgagcctgtagtcccagctactcgggaggctgaggcaggagaattgcttgaacccgggaggcggaggttgcggtgagccaagattgcgccactgcactccagcctgggtgacagagcgagactccgtctcaaaaaagaaaataatcattcacataatttgtcagcagacccaaagtggctaaggaaaatgatatgcaagtttctcaaggttttgaaaattgtctgcttcacgtaacactctttgtaatttagggtgtataaaatggataacaaaagcgaaagagggactgcttaaatcagactttttcattttttttttccactttatgtatttaaagagcttctatgtctttagactcaccagtacttgatagtatcagtcttaaaactttgttttgcttcgccagtttgatcagtggaacaaattttggttttgtaatttgcattttcgcaattactaatgaggttgagaggcaggctagtgtagcatttaagagctatggactccctgggttggaatcccattttgccacttagtacttactgatacggtaatttacttttgctctctgtgcctccctttccttacctgtaaagagggatgatactagttcctactgtatacatttgtaaggattacggtgctacaaacagtgcctaacatgcgaaaagctctattttaaaattatgtcttatttcatgtatttattagtcacttctatttctttttgagaagtctatcttcatatctgtttttctacttctccctgaagcttctgaattttgcctagaggaggacatatcttttttgtgtgtgtgacagagtctcgctctgttgcccaggctgcagtacagtggtgccatctcggctcactgcaagctctgcctcccaggttcacgccattctcctgcctcagcctctccaggtagctgggactacaggtgcccgccaccacgcccggctaattttttgtatttttagtagagacggggtttcgccatgttagccaggatggtcttgatctcctgacctcatgatccgcccgcctcagcctcccaaagtgctgggattacaagcgtgagctaccgcgcccagccaacatatcttaacaaatcagtttttgtgtgtgctttagtcaagttttttttttttttttgagacagggtctcgctgtgttgcccaggctggagtgcagtggccccatttcatctcactgctacctccgcttcctgggttcaagtgattctcctgactcagcctcctcagtagctgggactacaggggtgagccaccatgcctggctaattttttttttttttgtatttttagtagagatggggtgtcaccacgttggccaggctggttttgaactcctgacctcaagtgattcgcttgcctttggcctcccaaagtgctagaattacaggcgtgagccactgcgcctgattttaaacatattcctctagcactttctatagttgtttacattttcctcattaatctgcctgtaatttgtgtgtatgtcaggtggtggcaggggttaaaatgtacgtcaacttttttttgacaatgatagagaacttgaagaggaagaagtcttagagtcagatgtgaattagagtccgctctgcataacttaggcaagcccctgctgtctcttatttttgactctgtaaaatggagataatactcaatttctgtgctgcatagactgggtatgagaatcaagtgagttgtggcagagcacttcgaaacttcctgcagtggcttggtaacctaagtggtgaaaaatacttgggtattaatattacagaagcaagcccccaggtaagttttatataccatggtatacatttggttttgaatgtcttaagccaggtcataattagaaaacttagaaatgaaactttgcaatgcttgtgggaagtctctctcaatctcttgagagccagtgagttagaaccaatcagttaagtttctctatctggtggcaccttagagtcattcactgggggagattttttgcaaagttctgatgcctaggccttactcccagatactgtaatttatttcatctggagaggaacctgggcatcagtgttttaaacaaaatcacttcaggtgattttattgtgtagctgaagagggctactgatctaatgaatatagaattgaggatttggtagcattctcctgtacttgtttgctggtcagtttgtaaagaagagttccctgttcttaaacagttgtggccttgtaaccctgttatggctctaggagtggctggagccaaaaccttgccaaagtagagagctgagatcatctgacaaattcagttgtattggagtattatgtagtttgaaccctcttaaaattttaccagaggtttttggggggttttcagggttttttgtttgtagggggtggagagagcggggatcttaacagaaatttgttctctcacaattctgaaggccagaagtccaatatcaatgtgttggtaggtttggtttcttctctggcttgcaggtggccacctttttgctgcatctttacgtggtctttactctgtatgcgtgcacccctgatgtttctctccaaagcgtcaaagtttatgttaaaagtacttagaagctagtttaaaaaaccatttataatgccctagtatcagtgataaacgttagttgtgcggcctgccttgaaatgttttaaaaaatcactttgtactttgtctaagtacacatgttactgaaacaggagagttccctgacgccctcacaggatgtgtgacaggggtgtggctcatttattcctcttatgggaaggggagcacacaggtgagcaggtacaggagccagggtgagcgcttttgggctccggccccacagcagtgtctaggagtgttacaatgctcctttagccctgctgtcccagcataagtgttaaacagctcagagaagagtcagtgtgacagcctttttgggtttctgcatttagggcatcccgagttcttttcctgtgtctgggaagaatcaggtcacagggacttgaaggatggtgaatgtggggatgttattgagtggtggaggtggctgtcagtgggatggggagctggagaggggatggagtgggaagatgatcttctcctggagttcggctatctcacagccaatctccaacggcccccagcttgaacctcctctccacctttagacacttcctctcttctctccttctctgctgtgcttctctgccactcttctgcttttggagcctggggcttggggtttatatgggcacgggataggggtgcgtggcaggccaaaagggaacacttgggcgtgaaaacaggaatgcctgttctcatttagggctgcaggtccaggcttgagccctcaccagggaccccaccctcatacctcttgtccttattcttacagtgtaatgaatgcatcagcaaattgaaaacagatagtttttgccgtttcttaatttaattaaaatgacagttaagtactttgatatattgcctttggagtcatttccaggaggctatatttgtttgttttcttggtataatggccagtgtaccaatgatcagttttaagttaaatgtagtattaatgaaacttcagctttttactttctcttcttgtttgtatagcccctttttcctgattagattcactggtgatactaaattcgaacagttccataattcatgttttttatatctaaaaccaattactttttcccctttctatttgtaggttatgcaatggtctctgcaagatggtttattcttgaattggacctttttaagactgacaaatgctggtacttcatcttctataagtggactataatttcttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcaggtaggatgttgaagatactagttaaagctacagtggggctggactcagtggttcacatctgtaatcgcagcactttgggaggttgaggcaggcagatcacttgaggtcaagagtttgagaccagcctggtcaacagggtggaaccctgtctctactaaaaatacaaaaattagccgggcgtggtagcatgcacctgtaatcccagctacttgggaggctgagacaagagaattgcttgaacctgggaggccgaggttgcagtgagctgagatggcgccaccgtactccagcctgggtgacagagcgagtctctgtctcaaaaacaaaaacaaaaaacctacattggtgggtctactgttggggtactaaatgatggaacatgttctaaataatttgtgaagcaactgttattttaagttttgattaacaaaagtgaacacgttgggcgcagtggctcacatctgtaatcccagcactttgggaggctgaggcaggcggatcacaaggtaaggagttcgagaccagcctggccaatatggtgaaaccccatctctactaaaaaatagaaaaagtagctgggtgtggtggcacgtgcctatagtcccagctgctcgggaggctgaggcagaagaatcccttgaaccgggaggcagaggttgcagtgagccgagatggtgccactgcactccagcctgggtgacagagcaagactccatctccgaaaaaaaagaaaagtgaacataggtcttgcatagtaacaagaaagctcaagtggtgtagatggtaatacttgagtatgtagtccgtctttttctgatggcttatactgtcagtcattaaaattaactaagccatgtgtcaattctaagggggaaagcattaaatcattcagtgtagcctatggttagcattggacccatcataaatcatgacaccactttctaccccataaatacatacaattgtaaattgtcaatttacaataagattataaaaagaacatggacccaagtcatgttgcctagcgttcaaatttcagctttgtaccatacttgcgttatgactctgggttaattatataacctctaagcctcagtttgtttatctgtacaatgagggtaataatagtgtaactacttcatggactgttaaaaggatcaattgaattaatgctaaacatagattttggtattaaggttttatgctggccgcaaaactcatagggtgtacctctttctgttctctggatgaatttatgcgaagtttattatttcttcattaattgtttggaagattttactggtggacccatctggcctggggttttatttatggaaaagttttaattgaagatccattttttaatttggagatggggtcttgctcttttgcccaggctggagtgcagtggcgcgatcttggctcactgcaacctccacctccctggttcaagcgattctcctgcctcagcctctcgagtagctgggattacaggcacgtcccaccacactcagctaatttttgtatttttagtagagatgggatttcaccatgttggtcaggctggtctcgaactccttaccttgtgatccgcctgccttgggcctcccaaaatgctgggattacagacatgagccacggtacccggccgatccatttttttttttttaagtggaggaattttttaatttttagtgtcttttggtaaattatggttttcaaggaattggtttatttcatctggattttcaaatttgaggtaaagttgttaacgaccctttttattatcttttttgtgtcttggggcctatggtaatgcctccttatttctgatatttctgataccactaccaatgtcattaaaccttctaaaaacaactctcttggctttactccctccccccacacccctcccgccaacacacacacacacacacacacacacacacacacacacacactctctctctctctctctctctctctctctctctcgcgcacgcgcgcgcgctctctctctctctgttccttttgcttactttggatttggtttgctgttctttttctcatttcttgaaatggaaatttagataattgatttcagttgtcttttctaatatatacagttttatattgggaagtattaaattgaatggcaaaacattaaaacttacgatgtacagctcacatcacaacttaccttctatagaggtaagaggtaagttgaggtgtgtgtaaatgatcacaaacatgctgcttccaattattacatgtttatgtagagtcaggtaagtttttaggcaaaagtgttattttgaagtttttatactgttatttggggataagttcttattgtccagctattacagattagatattctatcgtaagtagtatagaaaagagcttctgtctgtctctcctttttcttctttctctgccattttagagaagtgaacaagtcgggggttttttctcccccaaataaatgtgtcagttttattccttttcctctctagttcccattttcgagacataaaatattaaagtgtatggtcacaggtcttggacagagttaagaccttcctgtgacataaatttgttagccagtattcaggtttttaaaagcgtagtcagaggtttgagttggatgctaaagatttctaattttacaccagaagctagtagttagagttccagtatctttccctcttcctttttcattttatacctgcattgtccatggaattctaaccttttttgcaatgtttctgacttgcatggctttagacaaaaatcaaacctttaatttaaccttactcttattttaaggtgtacttgatgatttttagagctcttgggtttgtgatattcaacctaatattctatgtctacattgtgttctttttcttctaaaaactttacatttttaaagatgactggtaatttaaaataacaaaggaatgaaacaaattacattatccctcactcttacattttgtttttctctactttttaatgttaggattttattttacaagatctgacacggttgtaccaagaagcagcaaccaaagtgttaatcactgttcaatttagggctcgctttttggatatgctttttatgtgctggcataaagggaatttctaaaatcagatttttcacttaattttttttaagcatgcctttaaaaaaaattctcttagagaattttaggctttagtatgtagtaaaactcgataaatgaaacagccttggcagagacaccgtgggatgaacactcttggatgtggttgctgggagggtgcaaattttctggaatgaaatttggcagtatttgtcagtggccttcaaagaaattgtttatactgttctagtaattatatatccaggatcctatcctaaggaaaagttgaagttcaacacaaaggtttatatatgagaacattaattacagctatgtttatgtttgttagcagtaaaaattaccaaatactaaacgtccccttaattttgtttaattcatgcaatattatctggccattaatatttttttaagattcttaatcaaaaaattgaatacctagatatattgaatggaaaaggacagagacttatgtataattccagttttattgaacatatatatggacagtttttatttactcttaaagattacaaggaaataaatatcggtggtgtttataggtgtggaattacaggtgttttaaattttattttttatattttctatgagcatgtgtaaactacctgtatatcagggggcaaggagttaaaaaataataaagcaggcttccaaagttacatacttcacatcagacatttttgttggacttgtaacacttgacttccgtgctgtagtttcctgtgccttgagaccagctctgtgagcacctgcacagttttactgtgttactgtgagcacctgcacagtgcaccatttagttactaattgaccatatgagttcatgtataaactttgtgagtaaaacatattaatgctggtaaactcatctgtcttcgtgcaagtgcttatttatgcaactctttattttacaactgttaaataggtgcttgaatgataaggcgaggggcccgtttctcttaaagggccatcagcctatagtgaatagaaaattcaagaacacatgaataaaaatcagtttaaaatttaggttagtttcattttgaaagagaaaataccacctgctttctgaattaagagtaaaggtcataaaagttcattcacttagttgtgaaaatattatgcactgttaaaacggggggagagaaagacatgctaaaaatgaggaatgaaagagaaaaatagccacgttagttgaaagtgatgttacttatttaagaaccataatcatgaacttctaaataattattgtttggataatggtttgggtgtagggaagttatggaataattacattttctcccttcaaataaaaaacagaagttataaattactttataatgtataaaatgtgatgtatcatatttgtggaataatttctgtcatggcttatataatgggaaatgtaagcagagaggcagtacacattatgattaagaacacaaactatttagactttgatagaaatcctgagtatagaatttgagctgtgtgatcttgggctacttactttctgagttttttttcatctattaaatggcagtaacatatttcattaggttgttgaggattagatgaaattattttaaagcacagtagtacagagatggcctgaaacatcataaactttcaattattttatcttttgtaaaaatttacaatgcagttgtcccttagtattcatggaggattggttccaagacctcttaccacttggatagcaaaattggtgtatgctcaagtccctgatataaaatggtttagtatttgaatataactcatgcacatctttctgtatatacttcacatcatctctagattacttatgatgcctaatacagtgtagatgctatataaatcattattatgctatattgtttggggaataatgacaagcaaaaaagtttgtacatattcagcacataggcaattttttctgaatattttcgatccaaggttgttggttgactttgcagatgcagaacccatggatatgtagggctatttacaaaatttttaaatctgcaatgcttgtctatgttggtgtttggattactattttacatatgttatagaaacttaaatgtggaatgtttaatttttaattaagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggtgagttggtgtgtaacacccaagaaagagagcagacaggaaagtaaccccactgcctccttaatagtctttatagcttcgtcactgccaagtgctttataacccatgattcttaatagatttaataaatgaaagggagtgacagtgttagtaaaaatttcacattaatgatgatgaccctagttgggttgtttccgaagtaaaattgtatgttcagtttccctcttggagagtttatgaagtttttttctcattggtctcttggttgctggatgactttcataatttttgggatggcctgaggtaaatcaggtcatgaggacattgagttcctcagagcctgatcctagtgaactcttgactagtttgagctatttaaccatcctagatgtttcctttttttggtcttcatctcagggaacagttcagaatataatttttcacacttatagtacaaacaaccaccctatcccaccccacacactttgattatttagaggaaacctccaagagagtgaagctttaagcttttgtgcagaggaagaaaaagatttcaagaggctagggaagagcacatcaaggaatcccatgtgactgtgatcttcaccagactgtgggctcaacaagtgagtgctaggaaggtgcgacacatttccccctcactccccaaaaggaaagtaatgaaaacacatgttcttaaaggcacttgctttactgagtttttttttaaatttcattttctaaaaataagtcaacactattaaatgcataatgtgaggggaaatagaaatcctttgcattaaaaaaagaaatctaaatacataaataatgagtatgcgttaacagaaatattttgtgtaggtaaatttctctgtaatttcccccttacatacacatattcctgccaaaaattactgttaacaatcaatacattcttcagattacctttgtgtttactatcatatatgaattgatttttctataaatagaggattcttactataattttgtaacttgctttcatttatcttgaatatttttcctattaataaattccattgtttttaattatatatttataagaatacattgtgtgattctggcaggtgcctatagtaatggtatataataaattatatttaatagtggtccctgaccattctctatagcagtgataccatagcagaaggttgtattgtttgttgcttttccatacttgtctggtggttggtgattggtaataaaatacttcttaggctaaagttgcatattattagcaagttctcaggggggagaaaaatacaaatgattttttttttctttttttctttttttttttgttttttgttttttgttttttttgagatggagtctcgctctgtcaccaggctggagtgcagtggtgtgatctcggctcactgcaaccttcgcctcctgggttcaagcgattctcctgcctcagcctcccgagtagctaggactacaggcacgtgccaccatacccagctaatttttgtgttagtagagatggggtttcaccatgttggccaggatggtcttgatctcttttcttttctttttcttttttttttccttttgagacggtgtctcactctgttgcccaggctgtagtgcagtagcacaatcttggctcactgcaacctccgcctcccaggttcaagcgattctcctgcctcagcctcccgagtagctgagattacaggcatgtgccatcacacctggctaatttttgtatttttagtagagacgtcatttcaccatgttggccaggctggtctcgaacgcctgatgtcaggtgatcctcctgcctcggcctcccaaagtgctgggattagaggcgtgagccactgctcccgggcaaccctgtctcttaccaaaaaaaaaaaggggggtggcggggcaatgaagaggtttatcataatgtctcctttgatctgaatcctgaaagagcacttccctatgaattttaacaaaaatatccatgatacctaattagttaatatttgattgttataatagttttatatcctaagttatcaagataatttagttttcttccctctcttattgctgtatcttttgacagtacctgtaaaaatttgtagagacatcaggtggtgcttagtcccacaaagcagataatctgccaaccttgtcttaatattttaatgttattttaatattaatattaaatattttcatagcaagataattataattagtagctcatttgtagtgcctcttttagtgtacaaccattaagcatgtttttgtttggtaaaacttttaggcctcgatgggtggttccagttttgccgaaaggggaattagaagtgcttttagaagctgctattgatcttagtaaaaagggtaagttatatgtttttatgcttcctataatgtatgctactagatgtatttttactttatcccaaaagcggatgaagtggatttgttttcctccatcataaacacatactgcagcttgcaaggaggggctcatatcctttggacattcttaaaggatgtttgtgaactctctgaggtcacataaaatttatatttgtatttctacggagtggattcattgtttcgtcagatttgcaaagaggttgtcactcagaggttaaacatttttaattgagggtcttatctgttatgggaaatactatacaaaagaacattttacaattaagtactctataaatgatggatggtatgatggactccagacatatctgccccctgccctccttgtaattatcttgagtcatttctgtcctcaaaatattactatgtaagtctacaaattatttacacttgacctttgactgctttactgaaatgacagtgaattaggatgtgtggctctttgtactcagtaaaattttacctagtaaaatcttcattcataatccttcaggtaaaaattaccatttcattaatattgtacttctgaaataaactgtctcgcttacatatttgtaagatagggtcttgctttgtcacccaggctggagtgtggcgatgtgatcatggctcactgcagtctctacctcctatgttcaagcaatcattctgcctcagcctcttgagtgggatacaggcatgcgccaccatgcccactaatttttttttttttttttttttttttgagatggaatttcactcttgttgcccaggctggagtgcagtggcgtgatcttggctcactgcaacctccacctccccggttcaagcgattctcctgcctcagcctcccgagtagctgggattacaggcgcccaccaccatgcccggctaatttttgtattcttagtaaagacggggtttcaccatgttggccaggctagtctcgaactcctgacctcaggtgatccacccgccttggcctcccaaagtgctgggattataggcatgagccaccgcgcccagctaatcttttttctttctttctttcttttttttttgtagagacagactggttccccaggctggtcttgaactcctgggttcaagtgatcctcccaccttggccttccaaagtgctgggattgcaggcgtgagctactgtacccagcctatttttttttttttattaatacacaggaaaggtgtgatttttctcttaaagaatcggaagatgaagtctcagtttttgtttaaccagcaaaaggaaatctggtgtttttactcagttgtccagaaaaaaagcttaatgctggaattaatcttttttttcccccaatgactttggtctactttaggtgcagttgaattatctaacagaggactaccattgtaataactttcaattcattttttaagatattgcagattaaaaagcagtaacatttcattttctgaaataggatagctatggatgtgttataactaacagtaggcactatcacaattgaaactgattattgtcaaaattaacatgtttagtactttaagttcaactccatggcaagggaaagtttgatttatcttttaataattcccctcttttgtttaaagaacgtgtccttatgcctcattaatcttgtagaaataatatcccaaagtgaaaatacaatacgcggacaggttacagttgttttcaccactcagaattttttgttcttttatacgttcactaattcatcaaaattttttaaagaaaatatctttttttattttaaaaatgttgaatttttatgggtatatagtaggtgtatatattttggggtaatgagatattttgatacaggcatacaatgcgtaataatcacatcagggtagatagagtatccattacctcaagcatttatcctttgtgtttcaaacaatccagttttactctcttagttattttaaaatgtacaattaaattattttttactgtactcaccgttttgtgctatcaagtaactaggtcttattctaatttttgtacccattaaccatcccgctattctttacgtccgtgagttcaattgtttgatttttagatcctgcaaatgagtgagcacatgtgatgtttgtctttctgtgcttggcttatttcacttaccatggtgaccttttgttccatccatgttgttggaaatgacaggatctcatttgtttttaatggctaaataatactccattgtgtatatgtaccacatttcctttatccatttatcagttaacacgtaagttggttcaaaatcttggctattgtgaacagtgctgcatcaaacatagtagtgcagatatcgcttcaatatactgattttctttcttttgggcatatcagcaaattttggaagacttctttgctaagcatgttctaagtcctgactgtaaaatgatggataaacactgattaatggtatttcatttaatagcattgacattcagtggacatgtattcctccctccaccatattttttttctgagaccacggttattttcaacaagttccaaatttttaaaagtttaaattaccatctcttttgtactatcaatcaaataatactttctgtacaaattgaatagtttttatttggtcattaagagttacagattttctttgtttggaagcacattgctctgttgcctttctaaaatgaggtgaaattaagcaaagatataaagaaacagagacactgagataattgagagaggctaataaggaagacaagacataattcattttatttgatcaaacacagaatagtataaggatattgatgctaaatgaatgatttatgaacaaaataagattttaaaaattgggaaatgcttttaaggtcaaagacttattttcagggagcaaaatactatttaaatttgcctcttcttgtggtgctgctgatcaccattttgtgtttaaggctagtgccataatttgtaacattttcagttagtgttaatattactcggttaatctacttttatgcaattaaatatttgttagctgtcggtgaagtttccagttatttattaccttttattgtatattggacaatgtaaaaacaaccagatgaacattttgtttgcattaatttttctccctttttcttaggccttgatgttaaaagtgaagcatgtcagcgatttttccgtgatgggctaacaatatcattcactaaaattcttacagatgaagcagtgagtggctggaagtttgaaattcatgtgagtcttgcatttgactttaaaggatcagatttacatagtgatgcctgtgagtgggaagaggtatatgtgtgtgtggctgtgttatatttattctgttataattgaattaaaaggtctaaaaatgaaaaacttaaaaatgtttataaattaagtctcttgaaggccgcatggtcatttagaataagcatgagatttagagttaagcttgggtttaatctctcctctgggatctcaagtgtctgtgaccttaggcaagtcatcacatttcattgaaaatgtaatgctatcaattgtaaggtacatcactgttttatggactattaaggaagaaaaacacccaagatggggcatttcatatacgtctgggacaccaaagggtcagtatagaggtaaatgagaaatgaacttgctatgcagaaagggacagcaaaaaatcctgcatatctcaaccttggcacttggtggagggagggattaaaaaaaaaagtgaaaatctaaaccacaagccagtatttaaacagtttcgtagtctgaattcaaattatagttgcaatacaaaaagcccttaagtggaaaatgtaaagtggtctcatgtcggtagtgcccccaagtgactagcagaagcaaacacaattcctctctgcaaataccttccatttaggaaaacagtaatgtattgttcattgattataagatagagtcagattccagagatcttaaaaagtgaaaaaagtatatgtctcagactgataaaatgccataactactctaagtctctgttgcttttgttttttgtgtgtccccccgcaagacggagtctcactctgtctcccaggctggagtgtagtggtgcgatctcagctcactgcaacctccgcctcccaggttgaagtgattcttctgcctcagcctcccgagtagctgggactacaggcgtgcgccaccacgcctggctaatttttgtatttttaggagagatggggtttcaccatgttggccaggctggtctcgaactcctgtcctcaagtgatccgcctgcctcagcctcccaaagtgctgggattacaggtgtgagcccccatgcccggcctctgttcttttgtatactatggaaatggtcataagttgtcaagcagataatatttttgtggcctataacctatttcccaaatatgaccatagcataaaaattccacattttctgatttaacatgtaattgtataggtgtagaaatggaaactttggaagtggcgtcagacttctgcatttgacatttagctagcaaatttatcttggatgattgacatattgtttattttatttatttttattttttgagacagagtcttgctctgttgcccaggctggagtgcagtggcgccatcttggcttccttggagcctctgcctcctgggttcgagctattctcatgcctcagcctcccgagtagctgggactacaggcacatgccagcacacgtggctaatttttgtatttttagtagagacagggtttcaccctgttggccaggctgatctcaaactcctggcctcaagtgatccgctttcctcagcctcccaaagtgttgggattaacaggcgtgagccactgtgctcagcctgacatactgtttagactctagaattgctgcctctcgtgtacaaattccacagagaaaaaatagtaacttgcatcttacctgtggacgtagagcaggaatagatatcttatggtgcctcttgtattttttaagccatagcaaatggcttttgaaagtaccatataaattatgaagtaaacaaattctaatttgtcctttgataatcagtttgatcccaatattaatgattagaaaaatggagagatcgttatttgttaggatacgattaatattggaagatatttctgtttgaaattgcagtgttttgatcttgtaaatcgcctttcccccttgtataacagaggtgtattattaacaatactcatcgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaaggtgtgttggtttgttattttcaaaattaaataatacaattgttttgttctgacacagaatcttcagtgatctgtatttaaagtgtgacaatgaaataacactttaaatgaaaatacacacaaccaggagcctttttcgtagctttgtcgttctagttctttgttttttctgcatgtataattatccccattgtcttctgtccagcctctttagaagtagtcataatttgggttagtaggaaacagactgtattttttctttgaaatagagtaggagattacttctttgaccaaggactcaattgttgttctgtagggccgtgatcattttaggcattctaagattttgactccaaaatcaagtatatcctctaaatacctaataatacatcataaaattacagaaattgttaatgaaatcaatatagtaaatcttccaaatctcacttaaatatattgtgtacataaatgtaagttttctatattggtgtaaacagactgtacactttaaaaaatttttccctaaacgctgcttcttttaataaatattatataattttaaaattttagattttagggagacatttttaatattataggtcttgtacaaatttccctttttctatccagccagaaagattttaagtcatacattatggagaacttggtttattttactaataagctgaagttatcaaaaaaaggtcaaacttaagttgagattttctgatatttcctagttcatatagttgccactagatggcttatttttgcttgagtagatcaggttactatctaaataatggcagtcttcaaaatgaaaattttaatctatacctgtatttctttttaaattttactttttttttttctctatgtgccagtaatccacaacttaagagattcacagggcacaaaacttgatttaacatggctaaatgtaaaatttttagatgacttctggttgaagatagttttatatctttgaaatatagttcttgctattaaacttataaagtgtagcgattgtgagagtgttagcctttcaaagccttcaagagtacaatttttaaaaatatagcccaaaatatagttgcgaatcaaggagaagcatattctatggagttaccttcacatttacttgctattgaagtaagagaaattttatcatacagctaaacaggtcttctataagcttttaaaaatctgattaaaaggggacatgtttggcagcatcttcaaccatgtcctagttgaatgcagatgtcatgatataatgaaaaatctaagagatatgtaatagcctccatatgtttttttctcctgttctccaaaagtggtagtggcaaaattcagatcatcagacttagtcgatggagataaactttctaagctgtagattcactttcggatactgtttgtaatgagtttcatttacctttgagaaatttgagttacagagcttaaaagtgttttattcggaatatttttgagccttaatacttaatcattctctggagcttttggtaggtcttctgttctacttcaaattctctctacacctcctaccctcctgggacattgaacctctgtggcctcaacttttgacccatgacaaagctaaagctgtcaggactatctctcagagtgtttcctaatccccatcttcccccaagatgtttgaagatgtttaaatgagatcatttattcaaacatttaaaatataataaaaacttcattggttacgacaaaaggtcttaggtgaaattcaccatgctatctttgagaaaaggaacttgtagcaatagaaaactatgtggaaagcatatggtgaattgtaagctatgtggtcattttgaattttctatttagggcgactgatctttctctgccagtcttgaaaacttagagccagagaaggaaagctgttgttggcagctgctgaagctagcctattagcctcagtttgaagcactcttatctgaatattcccaattgtttaagcatacattgcagccaaagaaatacagaaagattagctttagactaattctttactgtgtccacacctgctgttttataaatattgtatgtaactatcaagtatatcaatctaatagtctcattatagttactgaagaaataaaatatattacataatgagcatgtactttcttacaattgctgaatgacaaaagggatctggtgaattaagtactcgagttttaatggttttgaattagcctttcatgactaaaaaggtaggaaaacactattaaattgaaatacgttaatgggtttattagagaaacttagttcattcatattcttttaaaaccatataaaaactagcagtaggccaggcaaggtggctcacgcctgtaatcctagcactttgggaggccaagacgggtggatcacctgaagtcaggagttcaagaccagcttggccaacatggtgaaaccccatctctactaaaaatacaaaaattagccgggtgtggtggtgtgtgcctataatcacagctacttgagaggctgaagcaggagaatcctgcttgaaccctggaggcagaggttgcagtgagccgataatcacaccattgcactctgggcgacgagagtaaaactccatctcaaaacaaaaaaacacacagaaaaaactagcattagctatcatattttctctttaaacaaacattgaacatacagccatttagcatctttactttttcctgtattttttttttaaatagctgtagaaattatttttgcttaaggcttagaagagaaattgtgtattttgctccttgttttccagtggcttctaaaacatggcctaaattttagaaggtggcaaggtgtgaaaggttttcttaggtacattaatttctacatatatttgattcttatatttatatagccttttaattcattttaggtttttacatacagacaggcttttagcctcacaactgttgtctgtgccagctgtatggtactttgagctacagctctttcttagacagttcatcctgttgcatggtgttacttctaagataaggagaactgggtgcaatttgtataagcaaaagtatcaaccagcatattctacttaggaacagtagatactagtaccagaccttagtttttaattgacaattgactctcaggctattagttactgtgtttatagggaaattttaatgttttacaactaaacaagaagtagattcaaaattcattaccaagtagcttcttcttaactctcttgaagtctttctgcctcctgaaaattattttaatataaaagactttacagtaattagaaggtattcattcttatatggtgggatatctgaaataggagcatgtcttctaattcctgttcaccacttacattggtacagacagacagaactatgccccagtgatttaatctatacttactacgtatactgcttctgtctcacagatggaattactatgaacaaaatgcaatgttttgtggtcctttgaaagatgatttattttattgaatttactatttctagtatatttcaataaggcttttttttcgtgctttttaccctttaaagtaggaagttaacttttttcattaattgtgttacagggttggctagtggatcttctcaacaaatttggcactttaaatgggttccagattttgcatgatcgttttattaatggatcagcattaaacgttcaaataattgcagcccttattaagtaagttacatttaaaaatcaatggttagtgcaccgtagaattgctggtttttgcttcataaaaattgagtttttcaagtgtggtttcttcaactaataactgggattttttaaaagtaatataaagaatttagtcctaaattgattttaagaaattgcgtatttacaggagttttgtatctttcttatttcagaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttaggtaagatacttacctcttgaaataattgttaatgccgattttagaatcatacttatcactgaatttttcttacagattattgcaaatttcttctttcaatggaaagatgaatgcactgaatgaagttaataaggtgatatctagtgtatcatactatactcatcgacatggtaatcctgaggaggaagagtggctcacagctgaacgaatggcagtgagtctttcagttcttcttcataggaataagaatctacttaagacaagaaattagaatagctctagctaaaaaaattagtaatagtaacattttaaagtaaactgaaattgggaggtgttttgattgatttataactctgttaatcctgagaactttttgaaataacatagtttattatttggtagtgatatgggtagctttaaaacatctttgataaacttagtgatgaatgtggcgttttgaagtaattattagtttgttggagagtgggaagttggttgaaatggagtaggtagagttgatctagaaaatggattgggtagtatctagtaccttataaagtggcctattgttcatttgaccatttacagttaaacgttttaaaacaggaaataaaattactagaataagatctatacaaattgttttatcacgattttgagaattttattttgaaagcccttattttgacattgaaattttatgaaactttatgtaccatagctattttgtattatattgttttgaaatgagtaagtatgccatttaagttacagtgccaatattttttgaatgtatatgtgtaacagtcctggggaaacatctgtaggagaactgtccttgccctcaaggagccctcacttaataggggagttagtgattagagtatgttaaaatgcatgtggagactgcttagatattgccctgtgttagggggtcaggtggtagacatctggtttcatacatatgatgtacgtatctgcctcatggaaagtccagcacagagctattcaaagtgtgctctgaagactggtgctggttcttgaaccagtcctagataggacagagaatggcattaagtgtttagaaactttcattgcagtttgacattgcgacatttttattgtgttttacaaaattatctgtggctctgcagtggctcacgcatgtaatcccagcactttgggaggccgaggagagattgcttgaggccaggagtttaagaccagcctgggcaacaaagcgagaccctgtctccatattaaaaacatatgtgtatatatgtagaataacataaaaacaaatatctgcaacagattagacattaaaaactggctcattatcagctgagacatgtacttctctagcacattttgggcctaactactttttattctcagctaaatactgcaaaatcatatagtgtggattactccctgtttgtatcatgagttagcactttattctgttgctatagattaaatgaatgctagttgagcaagctagcacagtgttacagaaaaacagactgtggaagcatatgacttgattcatattccaattctagcatctgtgagcctgtttacattttgtaatagaataatgtatctcttactaggattgtttggaaaattaaagagataatggataagcaataatagtgcctagcacatgataattgttaataaataaaagtaaaaaatagagagcctttttacccaaggtcaaaacataattctgtggcaaaattgggataaagaatccaaagatcctaaaattggtcctgtactcaccctaccatggtgattgtgtacttaaataatatttttctgagtaaatgctggagtgtagaatcttcttaatttcagtattatttatgggagcatttctgtatgtgcaaaattgttataaaatttcataattttccattaaagcaacacataagtatattttaccagtattatattttgtaaatgtgttttgaatttccttatattatttaataatagtgtgagcaattaagaaaaaattgttttaatttctgctttcaaacacgtttttgaattaacatttaggaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggtaaggaatttaagatgatggctatttagtttttaaaataaagatactaaaaactgaagaaatacagtagctgtcatgaaatggatgcaggcttgtattgtttgactttgagaacgtttaaatgcttgttaccctgccaggaatctttttgaaataaccaataatcttttaaaaataaaaatattcttttatctgtatttgataaaggttgagaatttgtcagtggttttaaataaagatgcaaacagtaaaatcataaggaatgtctattgaaagagagtaaagacatctgtaattggtttcttcatagatttaatagaaagcaaaaacctccagtgtcaggagaattaattcacttgattatttataaagacctgtaataattattccagagaatttataactcttcagaaggattagtaacctttttagtttttgagttggaaactacaactccttctattatcttaatgacagttttctaatcgtggatttcttgggaagcattattgagttgtagattataaagctttgtttttttagtctataaaaaccaagaaaacagctttgcctttgagtgcttaaggttccagttttgaaacaatattgttagtgtgccttatttttgtatttgcaatattaaaattgtcaaattaaataaattgtattaaaggtttgtatgaaccgccaaaatacacattagctgtatttattatatcatgaaattaagttgccaggttttagatggcagttctaaagcattttataatgttagaatttttttttttttttttgagatggagttttgttctgttgcccaggctggagtacagtggctcgataccggctcactgcaaccttggcctcctgggttcaagtgattctcctgcctcagcctcccgagtaggtgggattataggcatttgccactgtgcgggctgtgttaggaattttcttgtgttacatagttaaatgaaggagataggagtactttattaattgtcagcaagcagtatacactacttaatctattactcagattcttgtgcattgtgatttcgtttttgtttttcaataggcagggaaacatgaagccattgtgaagaatgtacatgatctcctggcaaaattggcatgggatttttctcctgaacaacttgatcatctttttgattgttttaaggtaattgttaacatagcaaaatattaccattctatttcaaatagaattgattaattagatctgtgaattacttttagccaataaatacttaaatagaaatcccattaaacagtctgtggtgtgaaggaattggcccattgttttcttttccaacaagaacttgatgttcattttcttaatagcccccataatggaaactcaggctatcactttttctttctttcccctggtagtttctattttagttacaggttcaagcaaattgtaggactacagggaaggatgattggctacaataaacagtaagatgaaagcaagagaataccaatatcttggtattctggggtcatatgtacaagcaaaatatgagttaatcaaaatgtaactgataaggtagcccaagaactcctcctacagtcatatctgcattgatgccatcatgttggtttttgaggccatgttttgtaacatctttgattagttgccagggttaggtttgtgaaagctcaagtggttagtgaatttgtggattaagaacgtaactttttggcagtttgcactaagaggtgttctgttaacaactggcattagatcaataggtcaccaacgtttcttgttaaaaataataattatactgaccagtgggaacataaattgctatagccactttggaaaatacttggtatttctggtaaagtttaagattctcataactcatcagtttgacttctgaatatacacttgagaaactcatgcttatgtacaccaggatacgtgttcagcaacacttgttagcagaattacttgtaatagtgaaaaaacctgctatgtaggatagataaaacatagaatagataaattatggaatgttcatacagtgcaatatttcacggcaatgaaagagcaactcaaccatatggatgagtctaataaacagaaggttgaagaaaggaataaagccacacagtaattaatacaccttgattacattaatgtaaagttccgaaatgggcacagctggtttctgggatgttacttgccgtgtattattttttacctgggtactagttacacaggtgttcacattgtgtactgtaataatggtatatgcttgtacttttctagatatttcacagtagaagaaaaaaataccatttttactggcttccatcacagacatgttagatcagtaggtactgaagcccaagagtctgtattttaagcaagtttcacagataagtcttagggacattaaagctttgatttatggaaaaatcgctgccttatggaaaattttattttgaagggaacaaattattgagtgaatcttttatgtggtttttatatattttgtttctatacatgtaaaagcaaaacttaaatactttttccatccattgaagtatatcaaaggcagctgaggaaataatagaattggtcatcatgggcactgcaaagataaagacttccgaaatgatgatacgtgaccagtgatgcctttgatgagagaaggaaaaaaaggggttgttattatatctgctgtatcccccctcttctcaggatagtctaaatacaataatggtctgaatataataataattcttcatgttcttccccctttggcttaacatatgtttattgagcacttgtcatttggtaacaagcacttttttcccaaggtgttggtaaatctggcaattcttatggagtgttgaaagtttctgctaaagatgattttgaaaggaagcaatgaagtctgagtcaccttgtggttctttgcagattgcaaccaaatgattccaaccttctgggttagactttgctttatgtacttggcctagagcctagtttttaaacatttgagttctaagtaagtttcatatctttgccagcacttgttcttgtcagagttctgaatttttgacaatcttcttggtgtttgaaatgttacctcattgtgcttgtgcttttagtttttatatcccttgatcaataatgagattgagtatctttctgtatattttttgagctatttgccttttttttttttttttttttgggtgaatgcctgttccccccctccccccaccgtggcattatttgtatattttttggattgtagttcttgatatattttgaatgctaatctttgtcagttcaagagttacaaataatttctcccaatttggttatctttttcattcacttaatggttgtactggttgaatagatgttcttaatttctccttttcatgtagtttgtatgtctaaaagatgagtacatgaaaaaattcacgataccattatctacctaaaaaacaataattccttaatatcataaaatagttttaaaacttccagttgtcttagatcatacatcttcattttagaagtgagttttaatcaggatcctggtgcagtccatgtgtatgtcttttaagtctctttgaaactagctttcttcttttttacttcccttgcaatttatttgttgaagaaactggattgtttgttgccttggtgtctgtcaatagttttgatacagaaggttttttttttttttaattttactagagcatatctcaagtggtggtgtgcttttccttgaggaggaatacctagttgtctctctttttataatgttagctagaggtttttaattgtaatctgatattttagtcttacatttttagcagttgtcatattccttttgttattttgtgtaggctggaaggaaataaaaacaggcattcacatcatctttgaagacgtaccatattaataattccattgaactaatcttctctcattaacttaatcgttgttttttttttttttttttttggagacagagtctcactctgtcacccagactggagtgcagtggcgcgatcccagctcactgcatcctccacttcctggattcaagcaattctcctgcctcagcctcccaagtagctgggattacaggcatgcgccaccacgcccagctaattttgtatatttagtagagatggggtttcaccatgttagccaggctgatcttgaactcccgacctcaggtaatctacctgcctgggtctcccaaagtgctgggattataggcgtgagccaccgtgcccggtcagcttaatcgttcttctgctgtttgacgttaagttcgtttcagtttattttctaataaacactgatcagcaacttagtgcatttgctgctgctataacagaacaccacagactgggtaatttataaagaacagaattttatttggcttatgattctggaggttgggaagtacaagaggcatggtgccagcttaaccgtgagttttgggggggacattcgaaccatagcagtaactttactcataaaacttttcccatattgcttagcagcatccctggtctctactcactaaatgccattagtaccctgcccttccccaagcatgataaccatgttgtattacaataccattttagaggttttaaaaaaatgtattttagagtttttaattgggtgtcttctaaattgaaatagtgtatcatttatttttcttttttggaatttaactctaccctataaaaaaaataccaggctaactatattttcagatctcacttgaatcattctgtgcttagctacgttgcttttgatgaatttgaatatagttaacctggtgacaatttatgaagtggtgactaaatatgtgttgttttcatgtcacttaatttttttctaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggtaagagtgtactgctttgctcactttttgtgacttttccccttcagttaggttggcttagttacaggatagttctgttactctgacattgttagtttttaaatgatcttccggagttgactttttttgttcattagtctgctttccttaggatctgtacatcaaggttttgtgactcatctgaaaagcattttagtctccttgggagaaagtataaacagaacagattatacagtggtggcattatcaagtgtatggttctgaaatgccgtttcgaatagaattcgaatgttaaagctgatagggacttcagagggaagagaaattaggttttctttgctcatagggaagttaagaaaaattaatagaatttcctaaccattaaaacatttagtgcctccacagtgagcaaatcacacagtttccctacattctaatttgtggcatgtgtattttttaacacatggtaaagtgaacattgctgagtaatttctcacatgttaataaaactatttgttacactgatgaactggtatttaggtaagagccaagaaaagctcaggaaggtgtattaatgtagatactactcaggttttgactatgtttacttgtgacagttcggtaagtatttattcagcaaattaaatagtaataagggccttgagtataaattatttcattaaaccaagggtccttctgaggagtcttgaaatcagagcagtacatttgctatcagggcttttaactagtaacttcttttttaaatatctattagtatcagtgcctggcatagtgatgtacacattcattcatgaatagttactgagtttcactgaatttagtagactgttgccttttttcaacttcaactttcatttattgtttgggaaaaaatttttaaaagtcattttccaactgtcaccttttcccttctgcttgccaaaactgttgtcaaagtgtacatttgatcataaatgttttcatggccttaaaaatgtacacactattaaacccaacaattctacttagagaaatttcttctcggaaatagtgaaaaaggatacaaagaggtacccacaaggacattcattagtgtttatggacatgaacatgtggaagcctcctgaataattactttttttttttgagacggagtcttgttctgtcgcccaggctggagtacagtggcgcaatctcggctcactgcaacctccgcctcccaggttcaagcgattctcctgcctcggcctccccagtagctgggattacagacacgtgccaccacacccagctaattgttttgtacttttagtagagactgggtttcaccatgttggccaggctggtctcgaactcctgacctcaagtgatccacccgcctcggcctcccaaagtggtgggattacaggcatgagccacagctcccagctgtgaataattactaatagtttatacaaggttcgattatggcgccattaaaaggattaatatcacttaagagtatgattctaattttgctgccgaaaaaggaatatctgtgtattacaaaataaccccaaacttgaggggtttcaggaaaaaaaaaaaacaaaaaactccacaaaattgttttcctttccctgtacgcaaaagtaaaacaatccgagcttacgaaattgttaggcacacaaacttgcagttctgattactattgactttaggggaagaggtgaagtaactgaggtttgagaagtaaaataccataattgaaataattttgagtttataacatttttaatttttaagtttatatctgcctctgtcctttttctctccttgtacgtgtgtttctttattttgattttggcgattatttttaaatgtagttgtcattctatttattttcttagtcaaatatacattttttgtgttcttcactgtactaaaagatggcccatttagagtaagtcagggtcttgttatatattaattctggattttatgatacggtagaatctcttaaaatactggctaaatacctaccctctggcaaacttggaaaatgaaactttctgtcagtgtgcctaatacttaggatctgtagtgtgtacagatatatttcagtccatataatacaaagcttttataacagtgctgggctttttggagttctggtagtaagtgtgaaataaaaacaaacttaaagcttttattatttaaattaaactctttactgtaattacaacatgatgcttgtattgctaatcttaaaagaaaagcttttattttataattctcaaaataatttgaaaataaaattctcctgagtattgatctatttaaaacattgaaatcatttgtttaaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgaggtaagactttttaacatagaaaatttcaatacttaaaatttatgtactttattgaaaagaaacagcatattggctggcaaatgcaaatttttaaattagtggagtgagaagaggctatataagaagtgtttggaacaaaagaattctttattacatctacctcctttttttttattaatgaggaagtaagccacagttaagtgataaatcagaatcaaggtaatattgcctttgggttcttggttcagaattattattatatacatactatatttccagcaagtatgccaagaagtttcatagcatgtctttaaagatggattagaccacaagaacatttaaattgatgaaacatgacaagataaagtttcataatttttaaacatttattttagctaaatttctttttaatagctgtctttatactatcttaggtgtcatattctggttactgaaataatttgtcctattttctggtaatacagttggaactgataacatgaaaaggaaaaataatgtgaagagaaagagagcagggtgcagtagaaggaatattcacagtggagtcaggattcctaggtgtgaatcttgtgtcaaaccagtaatttaatcttgtaaaaattctgtaaagaatcatgtttggcctggtgcggtggctcacgcctataatcccagaactttgggaggccgaggagggcggatcacctgaggccaggagttcgagaccagcctggccaacatggcgaaaccccgtctctactgaaaatacaaaaattagccgggcgtggtggcatgcgcctgtagtcccagttactcgggaagctgaggcactagaatcgcttgagcccgggaggcagaggttgcggtgagctgagattgcagcactgcattccagcttgagcaacagagtgagactgtctcaaaacaaaaacaaaacaaaaccaaaaaacatgttttctttatatgtaagattaaatgattgccaggatcctttacagctctagattactatgattatacctcagacagaaatagaaaaggtcatgtatatgtctttatttaaacagttgaactttgtctcacttttttccctaaggctagaaaaaattagcaaattggaaaagctatagagataaacactgtaagaaattgagacatatatctcgttaacaataatatttgaggagcatattttgagtatgtttggctcatcgtacatatttcggcctttctcaaatgaatgcatttatctttcgaagtagacacagtagttcacatactctcccaagaacagtggccttgtctcccctaaaatagtagtagtggatgtgaaagttgattggtttcagtgaaggtagcaaaacagattagggtttcaatgaagatagcaaaacagatgagtctttgtggtgacacctgtgggcaaacttggctacaaacagagtgtcccaggatgttttcttaaatagctaataagaagaaaatgctaagagcattttctttgattgaattcttccttacaactgtagcataatctttgtgatgctagtcttgcaaaaaatgtttctattttataattttgggaataattacataacataagtgctttggtacagttatagtatagacattagtcattgaggtatactcccatttggtgaagttggagaatagtgatggatgctttttgtgtaaaataataatgtaataaatgtcttatcttttgaagagtttaagttggttgtgatattttcattaaaagaagtaaatgtacaaaagtataatttttaagtttttacatcagtagctaagaatttagatagtacgaactcttctggttacaacagagtttaattgcctaattatattgttaagttcttctcgtttcagtcaaactcagcgaagtccccatgtgttttatcgccatgacttaatcaatcaacttcaacacaatcatgccctagttactttggtagcagaaaaccttgcaacttacatggaaagcatgagactatatgctagaggtatgtattgtaagctaaaataaactatgggaaatagcagggacctttttttgcattaattaccttagaaatgtaaatcatgttcctttatggatttaagatccactattactcccaactcttagacatcctaaactctaggccagcagtttaagagtcttcactaagtgcttgccttcccccattctctttgttaaatagatttttgttctctgctttgggagctctgcctgccttttttacgattgatcgctaccttcttaggaatgtacttggctcattttcaacctttatgtcctttaccaccacctttagctttttaaaaggaaacttgttttgtctaagtctgttcttactttatagttcttttataatgccaagcctatgttttgtaagtgcttcaagactccatgaatttaaaaaacataagagtagagatgagaggctggctgtaagaatctagatgtttacattggcattcaaagtgtgaaattgtttgaacatgtttaggataaagtttcctgtgatttcaacagatcctgattgtaagtcttagcctgccatgtgtggagccctgtgtcagtgctcttttgccctttgacagttatgtcagtctgtgtgtgcaagagtagggatggcttctcagtatatactgttcctcttctgtcttatgacaaattcatacccctttccccactgatactttgttgtttcaagtttgtttcccgagcagtatgtaagaaaatactgtattacgaatgttagttatagagttaaacatactgattactcaacttaccattcatttaacatgttatgtaggatctgcagaagcccatagtgtatgttaaaaatgagaatatttataatactcattatttgaggagtaggcttttgacattattgaataaaatcccctcgtgcttaagaattaccagatttttgcttaatacttatgtacatttcccaatgaaattcagataaacataaaaattaagtaactcttctgatactcccagtgatagtgttgactctttattcttccatttatcccctcggggccaatagattgttagagctagacaagcaatctaaatgttaggcagctgatgaggaacagacagtgatcttagcattttagtcttaggttccttctaagcagtgtaatagaatgatcaaggcaatacaaccatgtgatttatgttctataccaaaggtactcaaaatcagtgacataaaaaagaggtttatgtgtagtatacccaagcatttgggtttagtatattatgattataatctcttcctggtggtacacagccctcatggttgccaaggagggccttcccccagagtggagacatataattcatacgtgctttaatgctaatttttatttacttcatttgcatgtggtgtttaatttcattgtcagaggtcaggaacccggctgtctcactagggttttttctgctacattttagtacaattctacttgagttaccgcctcatctcaacttcgttatcacaggaatgattacattcttcagtttttcctccttatgttgtctgtatatctgcaaactgagagatgtgagtctgcatagttgcctaggtctgaaacatgacccaaacatattagctgtatgactgtgggcaggttatttatgctagaataatgtctggcacatagtaaattcccctctgaattttaacatcatacctttttttcctcctaaccttggtaccttttcttcttccaatttattacactactcttgattaatactgatgagtctggagatagttaaatatgggggtgggggcaaataatttttaaaaccagtaaaattcttctattaaactttttacaacgttaaatcacttctgtggtaacatccactaacatttctaaatttgcaattctaaagttaattatggtttttgcctctataataaaagtgatagacaaatcccattagctatgaggcattaggttacttggcatgataacatcaggctttcacagtttactgatattctcaatttctgataaccattttaccaatggtttgtgctgcctgtattttatcttcactagcatctttagcttttgggggaaaaacatttcctcagtaagcatgatcagctgattttacctcctataaacattatttagataaaagaatgaacttagtaaaattctctacagtatttactcatgttctcactacaagtgttttcatacactggtacttaaattattctttaaaagtttttcatatgcatacaatgaagtataaaccaccttttagttttcactcaagttttaactcattggtagaatagtcattctactgacttcaatacttaccgaaagtttaatttaccattttttcttgtttctggatagagttggatgacccaacttcactgtaggtcagatttttccactctgtttacttaggatgctaccttctgttacttcttcccggtcttttccatccaacagtaacagtttttaggaacgttttccacacaaaaagattgctttatgagtgtcattcaccaacagtgctatgttagggtgcagatcctgtgctagattttctcaggactcattccttacatcaactatgaagtactattaagtctgtgtgacttctctgtggtttaaaaataattacatactatccattttgtgaacaatttgtaccttcttggagaaacggctgtttccaggcgtggaacagggaaagtaccacatgatccttgaccatcctattccagaaagtaagaaagtgctcaacgatcatgttgacatgtcaaaaggacacaggagttggctttcactggccataattaggtcaaaattagtaatgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggagaaaaatataaacaatagtcatttagagtacctgaaaattgtcctaagagggagtatagcaaatgggaaaacactcaagaaaatctattaaatctgcaaaacagcaagagtctgtagcatttgagccacagcttgttctgttctcccatgttcagatccagctttcttgtgtggaaactctactccaggcaggtgtgactaagaagcaggggctccttccctgaggctgccagtctagggctgtagtttgaccacatgaggtggtgtgggctactggcatttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcctaagggtattatcacaaatggagatttgggtgatgaagaattaggagagtgcttgtggctcccttatactggtatcagcaagtcacaggatgagcaaccagaaatttaacagaaagatctagataaagagatggccaagacaagctctcttgtgatcacagtcaaccctgggggtcaggaatgctacgtgtatgcattaggcttcacctaagcagaaacaatcagaactggacacgggacaaattgaaaacattccccaagcttcatgtcaatccgtcagcaaagggtgaaagcctcaccagtacagtggacttaaatacagctctgaccaaacaaagcattgggtgaataataagctaccccgactcaggggcaactcttaggaagccagacatgaaaattacatgtatccctggcagtctggaagacttgctgcatccttgctggagtgattgagaagggaacaagcaagctgctagtctccgaatgagcataggacaaaaacataaactttctgagtggtgtgatagcagcctccaagccacacagacatgcagtggtaaagggtaaaaatctactagtcaaggaggcttaaacacagcgtttggccaataaggggcttatactgatgcaggggcaactcctaggtaggcaggctaaaggattaaaagaaggaggaaaacatgggggcagagctgtcggaagctgtgcactgtgagggaaatagactatgaagtctatttcccagtcactatatcccatagccatagcccttatttcccatagtcatatttctgtttcccatagtcatagcccagtcactaaacaagcaagcaaacgggtgggggaagggagatcagtattcaggttgttgttgcatatctaacatgtccagattttgatgacaaaaattgaggcatgcaaacaaatgggaagatgggacctgtagactgacgcagagactgcctttgaaggaggccaaatggagggctttgcagacagacttgacagcaaagacttgaattacaaatatgctcatagaactgaagaaaaccatgtctaaagaatttttaaagtatgatgacaatgtctaatctaaattagaggatagtaaagagaaattattttttatttaaaaaatcatgtagagattttgtacttgaaaagtataataaccaaaatgaaatattcataagaggggctaaacaatagatttgagctggcagaagaatgaatcagtgaacctgaagatagattagtagaaattatgcaatctgaagaacacaggaaaagtgaacagaatctcagggaaatattgggtaccatgaaggggaccaacattaattttaatgggaataccagatgaatgagagtgacagaaagagacatagtcactgaaaacgtctctaatttgatggcagacaagaagcttaaaaaagaattgcaaatagggtaaatgcaaagagccccagactgagacacattatagtcagagagaacaattggaaggtggtgagagaaaaacgagtcttcctgcacaaggaaaccccaataaaaattaaccgctgacttctcatcagaaacattgaggccagaaggcagtaggacaacatattcaaagtgctggggttgggggacagacatgacaaccaagaattttacattcagcagcacagtctttaaaatctgaaggcaagctgaagatattcccagataaacaaagactgagagaatttgttgctctaagacttggcttacaagacaccctaaaggaagtaattaggcccaaaacaagtgacatcagacagagtgttccgaatttgcaggaaaaaaatacttgaatactataaaccagcagtccccaacctttttggcactagggactggttttgtggaagacagtttttccacggactggggggtggggggctcacctcctgctgtgcagccccgtttctaacaggccacagacctgacagacatctgtggaatactccatccaacaatagtgaaactactaaaagcacatatcatcttaatagatgcagaaaaagcatttgtccaatccagcctcttttcaatatagaaaggctcaaactaggaatagaagggaacttcctctacctgatcaagactgtcccaaaaaacccacagctaacctcatactaattaatggtaaaaaactggttgctttccccctaggaacaagaatgagacaaagatgtccactccaaccacttctatttaacattctgcttgaggcattagccaggataactaggcaagaaaaagaagtagacaacccaattaagaaatggatgcaaaggatctgaatagaaatttctgcaaagaaggcatacaaatggccaatgagcacttgaaaagatgcttagtattattagttattaggggaatgaaaatcagaaccacagtgagataatgctacttcatacctactagggtgacaaaaaagacaacagtaaatgttgatgaggctatggagaaattggagcattcatatagtccttgtgggattgtagagtggcacccaccttgcaaaatattaatcgtagaatttaccatattacccattcccagttacatacccaagtaaaatgtatacataaatctgtacaacatgaatgaactttgaaaacattatgctaagtgggaaaaagtctgtcagaaaaataccacatattgcatgattcttttttttttttctttttttttgagatgaagtcttgctctgtcgcccaggctggagtgcagtggcgccagctcggcacactgcaacctccgcgtcctgggttcaagtgattatcatgcctcaacctcccgagtacctgggattacaggcacatgccgccattcccggctaattttttttttgtagaaacggtttcgccatgttggccaggctggtctcaaactcctgccctcagatgatcagccctcctcagcctcccaaagtgctggaattacaggcatgagccactgtgctcagccatgattccatttttatatgaaatgcctcagacttaagcagggagaacaaagggagagggtggtttgtacagggtttcttcttggggtgaggaaaaatgtagacttagattgtgatgatgattatacaactgtactaaaaaaattgaattgtatttaaatggatagattttatggtactttatgactcgatgttttttttttaaatgaacttttaaaataagttctaaaatgggccctagaaaacttgctgtttatgatgacaagaaccaatttatgttagtctcagccatgattcactacctcttcctacctattttcatagacatctgagtaatttagtctcatctaattcttcctgctgttttcagcgggatatttgccacctagacaatatgagtcaaaagtggattatcctcctcatttgactgctagctaacaagtccaggtatttgttttgaactgaatatttactactaaactaccaatttatatatatacatatatatatatataaatttgtcttgacagcttggaagcttctctgtagtaagagggcctcttcattcctatttagcataaaggcatcttatttcttgacttttattgattagctgtcagctgaatgtttccaaagttctactctttgtgcagggtcccagttcttcataagtaaagtgttagcacctaaacaaaaaaagggaggtgggttgttagctaaaactagtgggcaaaagtttaacaaaatagttacatagcctcaaagtctctctctacaaattacttattaattacaaagagcaaaatagtacctttacatcagagaaacctgcctcccttctgtgttactcgccacaatgcttagactgatctaattatgacgaagtggcatggaagcccaaattgagtgacatttcaacaaaattgacctccagttttcaaaaaggtcaaagaacacaaaggatgattaattctgcagattaaagaatagaaagtcatgaaaaccaaatgcaatgtatatttaatcttgggctttgtagaaaagatgtaaaaggacgttattgggaaaattgatgaactcgaatatggaccatggattaaatcagtgctcctccgagggggtggaggtggctatttgacagtgtctggagctgtcttaaactggggttgaggggtgggtagaagcctggaatgttactaagtaacctatagtgcagtcctagacagaacagtcctgtacaacgaagattacctggccaaacgtcagtaacggaaaccctgggttagatgatggtagtattttactagtgtagttttcttgttatttggaaatactcattgaagtatttaagggtaaaaggacatatgtccaactcttaaatggtttataaagattatgcacacacgtgtatgtgtgtattttttacatgtgtggcaactaatgaagcaaatggaggaagatgtaaacaattggtgaatacaggtaaagagtataagagaattcttgcctttttttttttttttttttttttttttggtgacggagtctcgttctgttacccaggctggagtgtagtggcacaatcttggctcactgcaacgtccacctcccgagttcaagcaattctcttgcctcagcctccagagtagctgggattacaggcgcctgccaccatgcctaatttttgtatttttagtagagacggggtttcaccatgttggccaagctggtctcgaactcctgacctcaggtaatccgcctgccttgccatcccaaagtgctaggattacaggcgtgagccatggcgccctgcctttttttttttttttttttttttaaagagacaaggtcttgatgttgcccaggctggagtacagtggtgcaatcatagctcactacagccttgaactcctgggctcaaaccatcctctcacttttttttttttgagacagggtcttgctatgttccccaggctggtctcgaactcctggcctgaagcaatactactgcctgggttgggcttcccaaattgctgggattacaggcatgagctaaaacttgattttctttccagtttcttaagaaaacctcttgaagtagtcctttaagtcccaatctctgatgaaatatgcattcctgaaagtagagtgtttatgcctgtttgcatattccaatatatgtggaattagaaagtagtttggtcgtaatatatggggcttttttctttaccaaagcatcaaaaccaaatatgtttccagacattatgaatgtcccatctttataacacatcaggagtttgttcagagaagaaacatcaatgttttgaagaatttgattactgatttccaaaagagcttacataattagaatctttaacaatagcttgcacataccatagggtctgggatctgatatggaaatatagtaattaatgctgaaggaaaatgacacattctggacattaacatggtaatggtgacaattgtatgataacttggtcatgtagagtagcatcttgtgttaccctcacttcttaggtgtaaattagtaatatttatttttataccaaaataattttttcttcatgaaaacacctttcaatataacaggtaagaaattgaagaaaaaaattttgtcttccttatcagttcatagaccacttaggtcagtcttaggctgcaatcatgaattgcttcattgtgtgtgaaggttgcacgaaggggttgtgctgaataattatttttgatagcatatttaacagattattttgttttggttatgtaacaggaacgtatttttgtggggaaaacaggagatggatagaaaccaccaactggtagaatttaggttgccttttaatgataaaggattagtgacattttaactggcctaatttctttggttgaagtcaaagcagtgatttgggttatccatgtgtataatgcatggttttttcttaatttgcagaccatgaagattatgacccacaaactgtgaggctgggaagtagatatagtcatgttcaagaagttcaagaacggcttaacttccttaggtttgttttatacagttagtgttgctctctttaagaaaaagataaggaatacagaatgaatagactgtatagcttggtctttgttgggtggccttttcccaagtccccaagtcatgtaagacatttccctgtatttgttactaaatactttaaaatgattcgctgagttttaactttgttgcaatattttaagagaacacattttaacctttagaattgacttcgttcttcatatctgtttatgctggaaataatgtttatttttaaagggcaaattcccatattttgacacaaccggaaggaggactatactgacttaatgatatcatagacactaaggaaacgggggcaaaaggctgctagaccagcacctcaaaagagtggttggagtcctctggtatcttgtttattctaacagtggctgacaggcaatctaaagtcatgtgttaataatatcatttctgattggcttgaggggaaaaggtttattaagataaaatgtagtctagggctggattttctctgcaatatttagcgtttggtgatcatacacttaacagatgtgcaaagtgcctttgttaaaaattttgatggtcaggcacggtggctcacacctgtaatcccaacacttggggaggccaaggcaagtggatggtttgagcccaggagttcaagaccagcctgggcagcatggcgaaatcccatctctaaaaaaaaatacaaaaatcagccaggcatggtggtgttcacctgtagtcccgggtactcgggaggctggggtgggaggatcacttcaacctcggaggcggaggttgcagtgagctgtgattgcaccactgcactccagaccctgtctcaaaaaaaaaaaaaaaattttttttttaaatgagaggttccttttgaattcaaaaaaccacatgtagcaaaagagcttgtttagattacaagtgtgctaacagaaatgcccagattatcactgcttcttgaagtctattttatttatttatcttatttttttgagacggagtctcactctgtcgccaggctgaagtgcagtggtgagatctcagctcactgcaacctccacctcccaggtacaattctcctgcctcagcctcccaagtaactgggactacaggcatgcgccaccacgcccagctaatttttgtgtttttagaagagacggggtttcaccatgttggccaggatggtctctatctcttgacctcgtgatctgcccgcctcggtcccccaaagtgctggtattaaggtgtaagccaccgtgcctggccccatttattttaataacatattctgggtagttttgtcctgggctgtgttaattatggatttctatttattgaactctgtgcttatttatggagaaaattttaagtagctatataatgattttgaggaaaaacctctaccaaattttaagaaatttggcatttgtttaaagtgcattgtttttttttttcctgtgtgttttgtttttaaccacctggatagaaggacttgcctcctccccacattgagagttactgccatagtaagcagtcgttactgattggcatgtgttatatgtctcttaggtttactagaacagaaaagtggtttcaagcctttttgccattttaaagtttggaatcagaggaactattgtagtttctactctgttagtacctctgtatgtgagctaatagcaactaactcaaggaagaggaacctgactttaatgcctgctgtgtgttgggcctgtgccagacactttatatttactccgaagcaacacagtgcagcaggtgttactcccatctgatcagtaagaaacccaagattccaatggcttaaggtagcttgtttgaaatatcacagccagtatacgatggaattgcactactcaactaggtctcttttacttaagtctgtgctcttcctattagaccggtagtttttcaaacttacgtaggagctttagggcttctgagttaagttccttgaagatttctgaacaagcagtaggaagtttcccgatttttcctttctttttcctctcccaacaactggtgcagctctactttttaaaatatatatcagattccaaatgggattttcatttgaagaagggtctatgccatctttagaaaaaaacaaaaaaatggaaaacctttgaaaagttaagcagttttaactcataaatattgatggattagttatttgtgaaagtcacttgattgaatacctcatttttcaatgatgccatataagcaggctgctaagtcttttttctggttgttgttgttggagacagggtctcacccaggattctctacttaaatatgactgttgttaattgagtgctacaattaaattagccattgccatctttaattggagtgcagcggcacagtcttggctcactgcaacctccgcctcccgggttcaattgattctcatgcctcagtttccccagtagctgggactacagacatgagccaccacacccggctaatttttatatttttagtcaagatggggttttgccatgttggccaggctggtcacaaactcctgacctcaggtgatccgcccacctcagcctcccaaagtgctggcattacaggcgtgagttactgtgcccagcctaagtcttttatttttaactcaagctactaaacatgcttctttccaaaagtctggtttcaaaaactaaaggttcatggaatgaatcttttattcctaattcagctagctgcatttcaggcacaaagtgggtgttcagtgtgtgcttgttgaattaattaatatctagtggggatttttttttagtaccagataaaagtagagaaataggttattttgaaagaatgaatatctttttatctatagttaaaatataatggtgataaatgtattttataggtaatacagattgcctttccggataaaaattacataaatctaattgccaattttcaatgttttttcaagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtaagtcaaaagtaggaactctgtaaatggtgtctgatgtactttttcatgtacgtaaggaattgtaattttgcatataaattgtgtattttactctgatgtttgtctcaggaatttggtgtagttaggaattgttcatttttattatgtcacctgtcagtgggctttttcttctctcttcctctccctcctcctgccactgatgttccttttgtcttagcttagtatctgtgtattccatagatgtgcactaaacatacaaatctttcattcctcccccgtggatattaatgttccttcccgagttttcattcagtgtcgatctgtttcctcctcttcaatgtttaacactaaaatagaggacagaagagaggacttgtgtttagtatagattatgagtatatgctttattggcactgtttaccttgtgatatttttaaatacctgggggaataaaatactatctttttaaggctaatctatttttatagtactactctattatgcctatctttaatctgacctgttatacagcagtttatattgtttggatgtctcacatattttcctgcaaaccatagataaagatgtttattgtggcatttgagtatttaaaagcttttaattaagtatgtggttttcaacattgttttaacagcagaaacacatcttaaaactcaaaatttgcaccacactacaaaagtaaactgaattgaacaaggaaaatatgttttcttacttggtctccccatgcttatcccctttcccctccccaacccttttataggggccaacactgaaacacttcctcaaagtcccctagggttctgaacatagtttggaaaccactaatgtaattagatgagtgataaagatttatagaaactgggggtagagtagtcctttatgctaaactgtgtttcatgtaatctcttatttcctgtcaactaatttgaatttcttcttgagtgtctcacttggttatcaagatattaaattatagggttaaataatagtggtcaaagcgtattttatttttacaaaaatgtacctttcattcttaaattattcagagactttcattttgcatttattaccctttcttttggtctgtgcttctcacttaattttacttgattatcaaagtcaacttaccattaaatcattgaatagtgtgtttaagataactgaggatatggtttgaatttaaatgcccaacaaaaatatatgttgaaagggatgaatacttttatcattttgaaaccaggtcgtgattcagagtaatgatgatattgccagcagagctatagatctcctcaaagagatatacacgaaccttggtccaagactacaagtcaatcaggtgaggattgatgtgcattaaaacttccatatataattctttcggcccccatttctcttatacaaaagagaaaaaatattatctaaatgaatcttgccttgttagttgtcttgaagtgattgggttatttttaatataactatttattagatgttgaaatggcaaagaaagtctatgtgaattcattttgatgctaacacctaatcctgaagttcacttttgactaatttatgtttgttaacttatgtaatgctagcttccttttaataaacatacattttattattgtatggattctctacttaaatatgactgttgttaattgagtgctacaattaaatcagccattgccatctttaattggattaatatttggtttttacattttaaagcaattttaactgtgtttatttggcctgatatttgtaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgaggtttgtgaataactaatctattggtgctaattcttaattatttgatattttcctagccatttggtaaaaggagagcagaaatttttctcgtttgaaaattgttgtctttgcccattaaaaacattttcatttcatctaattttttttaataacctcccccactctcccatctggttttgttttggttttttgggtgaggcattcttaagttgttttctagttttctttttgtctttgacattattactcattaagtgttgcagtggcattttgcagttgaagtgtttttgtttatttgtttattttgagaaaaggtcttattctgtcacccaggctggaatgccgaggtgtaatcatggctcactgcgggctcaagcgacctttccacctcagcctcccaggtagctggggctacaggcacaggctaccacacctggctaattttttttgactttttgtggaggtggggtttcactacattgcccaggctggtttcaaactcctacgctcaagcaaatcctcctgctttggcctcccaaagtgctgggattataggcgtgagctacagtgcctggcctgtaaagagctcttaaaagctgccttgcatggcatataacaaatattttcaaatggtgtttatagttttgggatgttttgtgtagtcaatgccatcattttttttaaagagttttgtttattaatcatgaaattatatacagttgcttcttgaatatgatttttattttgtattttactttaaaaaaggtactataccaatataaatagcattttggagtgaattttgatatgaaggcttttttccagaaaaaaaataaagtgcattgtggcatttttgttgatgcttttaacaaaatgtaaaacgaccttttaaatgtaaaaggtaaactctaccttctttttttgaatttttttttttattaatacaaggtctacctatgttgtcgaggctggtcttgaactcctgggctcaagggatcttctttgcttggcctcccaaagtggtaggattacaggcatgagccactgcgtccagccaaccttttacatttaaaaatagtcttagtgagttgggcttttacagcataaaaataagcgttatatcttggatttaatttcattttagtagacacctcattttctgcaaccatagatacaagactaacaacaatagaatatgattatgtttttaaatattatttatatttttagttaaaaggagcaatatttttttttcttttgcatttcactcttgttgcccaggctggagtgcagtggtgcagtctcggatcactgcaacctttgcctcccaggttcaagcgattctccagcctcagcctcccaagtagctgggattacaggcgcccaccaccaagcctggcttattttctgtatttttagtagagatggagttttaccatgttggccaggctgatctcgaactactgacctcaagtgatccacccgcctcggcctcccaaagtgctgggattataggcatgaggcaccatgcctggccttattttcaagatactgaaagtaatacaggttgagtatccctaatccaagaaatccaaaatttgtctggtcccagacatttcatataagggattctcaagctgtattaagtatctttaattcacatcctcttgtttaataagaaaatacttagtgttaaatccccagcattattttcttggcaacaaaatttcagagtctgctgaatatgatgatgtctgtctttctttttccccccagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcggtatgtatgtatagttaacagatttttcaataaaatcaaaccagagactatcgtttaatcagtaaatactaattgagcatttgttatgtttgggactgtgttaggtgttagagttatagcattaaagtatagcatgtagtctttcggattttttggttggtatatcactaagttttgtgttttgtgtaagtatttttccttgtttttgatattaacatagtatataattttcagcttattacagccaaacttacacagataagttccaatatgccttcaagccctgatagctcttctgattcctccactggatctcctggaaaccatggtaatcattacagtgatggtcccaatccagaagtggaaagctgtttgcctggagtggtgagtagatacagttttgaactactgtatgtaaggcatcatgctagggtttttgagaataaagtatatagagtggttctttcttttcttgaggagcttacagtttaatgagacaaaaaaatacagttaaccaccaacttcagaatggatccctctaaaaggtaattgtaacacagttggaatttaaaacataatttccccataggtatagtattgttacttttacataaaattaaccaattagagcttaattataacactattggatgtataaatttagaggaaaacagtcatccctcgtatacgtggagaattggttccaggacctctgcatatacccaaaatgctgcagatgaccctgtgcaaccagatatacaaaaagttagccttccatatacttgggttttgcttgctggaaatactgaattttctgtccacatttgattgggaaaaaagtctgcatgtaaatggacctgtgcagttcaaacttgtgttgttcaagagtcagctgtatcactttctaaaatttataccacaaaacggatagttcttttagaactatatatgagctgggcatggtggctcacacctgtaattccagctactggggaggctgtgaggcaggaggattgcttgagcccaggagttctaggctgcagtgagctgcgattgtgccattatgctctagcctggtcaacagagtgagaccccatctctaaaaatataaataaatgaaaacaagaactatgtaggaaaatacctgtaatctttatcagattgtcagtaacatatagccaaagaaatatttttaagctctcctttcgcccctcccgacagaaattttaatggttacaatagtagcagccactccagtgtcaggaggatttggctctctataacaactggattaagaatttggtagtgggcatggcagccttttgttatgtccagagtctaaattgtatatatgagagaaatggtttaatagaacaggagaggagctatcacaaaaaaatgactggaagtgacttgatgatgtatttgatctgcactattaaggatttgtagggattaaaagatgggaaagtcagactatttcaaagagtagaaatttcataagtaaaagtatagggattaacacagagaaacttacttgggcttttataaaacgggagtaaataatttagaggtaattattttgtgtattttatattctagataatgtcactgcatcccagatacatctcttttctttggcaagttgcagacttaggtagcagcctaaatatgccaccccttagagatggagcaagagtacttatgaaacttatgccgccaggtaagaatttttaaatgatgatcaagtacttgctggacaataaaggagtatattagcaaattctgtttctaaatggaccgtgctttttggtatagactataacaagagttgacagatgacagcccacaagccacatcaagccccctgcttgtttttgtgcatcccaagagctatatttttaagtggctacaaaaaaaaaatctagaagaataatattttgtgatacatgaaaattatatgaagtttaaattttagtgtccatgatcaaaaccaggctcatttgtttacattcagtctacatgactgcttttgtcttaaaatagcaccgcccaggagttgtggcagaggccatatggttcacaagcctaaactgcttaactttcctggccctttacagaaaatgtttgcctatacctggactataatatgggtcatgtgtcatctgcggtattgttccttttttatccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccacatcctcccagtatttgcttaaatccagattcaacatctacgtttccaagattgtttgaaatatagttctctagatcactgacaacttttatcctggatttaataatttcccttttattttcctgattgtacacctatcacttattcttcccacatacttttttttgagatattttttatctgaatgtgggcaaactatcacgtttgattaatggtttgtgtatagaatcctaggtttgaaaatatattccttctggctggtggcattgctgatgagaagaccaaagtcctcttggtttctattcctttgcatgtgaccttcgtttctggaagttttggttttatccttacgttttgaaatattatgatgtgccttagcgttaagtctgttttgtggtgcgtcacctgtgggcctggagatttcctcagttgagagagatttgtattctttgatagttttctcaccagcattttgcgttttgtgtgtctttgaaatgtctaagtgtgatggtgaatttactagatctgattttaccttttctctcttcccttctctctttaatcttattccacctttggggtggcttctttaaccttttccagctcttctgttggcttttcccctccaaatattctagtgttaaaatttcaagacctttgtctccttagtgatccttttccatatacaggattttgtttttcactaacacattcttgcatttatgttctaatatatgtgtgttcctttaaaacctaatgttcggcaaaattatgcactaaaaatagtagggcttttggggaaaaagtagagttttggcagatcattcaagcctatacaacctaaaaattttttaaatgtattttttggaaatacttacaatcttacagaaaaattagaagtataattcaagaacacttgagagtaatttactggtttttgtagtcccatcgcccaccaaatactttccctacaaacaaggatatttgtctgtataagcaaaattaagccatctataccaggaaattaatgtcgattcattactgccatctacttagcagactctattgagtgttttcagttatctccttcacagcaaaaagatatagttcaaactcagatatagtcagccctccatatacatgggttctggatctatggattcaaccaactgtggattgaaaatgtttgggggaaaaaacattgttgaaagttccaaaaagcaaaacttgaatttgccacatgctgagtactgtgttgaatccacacgaatgaagctatgtgtaagcattgtattaggtgttacctaatacaatgtacagttaggcaccagataatgacgtttcagtcagtgatagaccacatatacaatggtggttctataaaattataataccatatttttactgtaccctttctatgtttaaatacacaaataccattgtgttataattgcctacagtattcagtacagtaacatgcttgtatgggtttatagcctaggagcaataggctataccatatataacctagatatgttgtaggctgtatcatccagatttgttgtaaacacaccctatgatgttcacacaatgatgaaatcacttaatgatgcatttctcagaacatatgcaacacgtgactgtaatctggagataatttatacaggaagatgtgcatcggttgtatacaaattccacatcattttatataaggtatttgagcatccctggattttggtgttgggagggtggatcctgaaaccatccctgcacccccaccccccatggataccggggaataactgtattgcatttagttaatgtatctctttagtttccttctgaaacagttcctcatactgtctttgaccttcatgaccttgactcttaaagattacaggccagttaattatagaatgtccttcagtttagatttgttttatcatgattgtattcaggttatgcgtctttggcagaaataccacagaagcgatgttctgttcttctcaatgcttccagtcagatagtatgtaatttcaatttttcccattactgacgatgatcactgtgatcacttgagttttttccttgcttccccactgtaaaattacccttccctttgaaagtattttgggccaggcacagtgactcatgcctatcatcccatcactttgggaggccgaggtgggcagatcgcttgaggccgggagttcgagaccagcctggccaacatggcataaccccgtctctactaaaaatacaaaaattagccgggcgtgttagtgtgcacctgtaatcccagctacttgggaggctgaggcttggacctgggaggcggaggttgcgttgagccgagatcatgccactgcactccagcctgggcgacagcgagattctgtctgaagaaaaaaaaaagtattttgtgcagaggtactttgaaaatatttatactgttcctcatcagacattttattcattcgtttatatctgtatgaaatcatgatcaaggagttataatctgttactatcatttatcttgatgctgaaatgatctcgtttggccagtgggagtcctttcagactgttctgtgttactttaatatgttcccattattctttcagcacttgtgtgctctttggctcaagatgtttaagattaggtcaagtgtagtggctcacgcctataatcctaacactttgtgagggtgaggcaggaggatcactggagctcaggattcatgaccagcctgggcaacatagccagacttcatttctattaaaaatttcaaaaattagccaggtgtggtgatgcgcacctgtagtcccagctacttgggaggctgaggtgggaggatcacttgagcctgggagatggagactgcattgagctatatgatcaagccactgtactccagcctgggcaacagaacaagacgctgtctcaaaaaaaaaaaaatttaaaaaagttccagattaacatcctgtaccctctctgccccagtcctgaaattggctgtttctccaaggaggcctgtttgatttattttcctggagaatggtgtttagaaaccaagatctggacatttattgcactcattgctatcgatgtattgttgctccctggctctctaagcagttagagctaaggaatgtgtgtatgtgtatccacatttaagtctattactatatatatacacacacacacatgaatatatatatgtgtgtaagtttttacaaaaccatggggtcacacgacttcctcccatcccagcctatcacagtttcattctagttttctccctttctatatttgtaattttttttttttttgagacagagtctcgccctgtcacccaggctggagtgcagtggcgcaatctcggcttactgcaacctccgcctccctggttcaagggattctcctgcctcagcctcccagtagctgggattacaggcgtgagccaccatgcctggccaaactctcttttctgacaatgaaaaacctggcttctgttatcctctcacttattttcctatttaatcagttatctccagaccccccaccctttctttgaacgcagaaggactcttgtctctgaatgttgggtctctaccccagggacactcctcgctctgcttgagttgaatctttatgctgagctctacccacttattgggctccctcctcctccttcatggtctgtaattcccaacataggactacctttaaaacttgcacatagtttaattagagcactcataaaatgataattagtatcctcagagataatttggacagtccaggcaggtacttcagtgtggctgaaggcttcctcaggagatagtaaaaagacacaaaaccagtacagaggaaatgctgacttgacattgctgagatacagtgcaaaagagtggagctctgagatagatgggctaccattaagataggcacagggggaagtagaacctgccaaggtccatgaaagtctagtttaggattgtatctcacaagatgagcccttgatgcaagtattcactttaaattttcctttaaaaagaaacaggcttctgcttacacatctacccagctgagggggctttttgctttgctcattttaatttttttgttgaagattaacagttctgttgttctggctactgttgcctggaagaaatcacacatgaacaaactcaccttctgcattatactgacatcattatatttgccaattgattgtgagctaattggggttatagaaacgtgctatagcataacagactgtaattatttctctctaggctattactgatggatattatgttttcttctttttccagcatcatcttttactgtccttgagttttttaactagctttttatattaaaataatttcaaactgtttacaaagaatacagttggctcccaaattcagtaattaacagtttgccgtagtgatggcaaaagtttcctaacatttggagaacaagttgtagacaatcatctttttcttcctaaatagcttagtatatgtcttctaaaaacaagaatgttctcacttacattaacatagtattattcaaaataaaaaaaatttagcatatacagtaatatcatctaatctgcagaccattttcatattttgacactttcctcagtattggactttataacaatgttttctggttgaggatctaaatccaggttcatacattgcataattattcggtatctctttcagttgtctttaatctggaatagttcctcagtctttgtcttttgtgactttgtttttgaatggcacatgtcagttgcgctgaatatctctcattgggtcttatctgttctgatgattatatggaggttgtacatttgacagagtactacttgtatgttgatgtgtctaagagcatcacattgagagacacatgtcactgtgtctttggtgacattaacccagatcacttagttgatagctgccaggtttctcctctaaaggagagagatgctttgtgtagagagatgctttgagacttcgtaactatctttttcctcatcaaacatttgttttatcatctattgtgattgttgcctaaatgtttttactatgatggttgcaaaatggtaattttgttttaattttgtcatcctttctacatttattagttgacattctataaggtagtgctttgttttctcgcctttatatttgtcatatatgatcactcttatgggtttattttattcattgggttataaccattgtaatggttatttattttgatgctcaattgtcctagatatggtcagtggaagcccctataggttagacccagacatacaacctcaatttttttaaggtactttattgtactttattattttctggtatgagaagatgtttcaagcttatctatagtatttcctctgccccagctctggaatctgccattccagagtttttagaaggaagggtatttagaaatcaaaatccgaggtttaaatcttttttttttttttttttttttttttttttgagacggagattttgctctgttgcccatgctggagtagtgcagtggcgtgatttcggctcactgcaccctctgcctcctgggttcaggtgattctcctgcctcagcctcccgaatagctgtgattacaggcacctgccctcatgcccggctaattattatatttttagtagagacgaggtttcaccatgttggccaggctggtctcgaacgcttgacctcaggtgatccacccacctcggcctaccaaagtgctaggattacaggtgtgaaccacagtgcccctgccaagtcatccttatttcattctaattgtggtaaggtgatacctcattgtggtttggatttgcatttccttaatgattagttatgttgagtgtgctttcatgtacatgttggccatttggatgtcttcttttgagaaatatctattcaagtcttttgcccattttaaaaatcggattttttgctgttgagttccttatatattctggatattaaccccttgtcagatgcatagtttgcaaatattttctccaattctgtagatttgtctttttgtggtcttatttcctttgttgggtagaagctttttagtttaatgtaatttcgtttgtctgtttttgtgtttgttgcctgtgcttttgaagtcttagccaaaaagtccttgcccacactaatgacatgaaacatttcccttgtgttttcttctagtagttttatagtttctggtcttacatttaagtttttaacccatcttgagtttatttttacatatgatgaataataggggtttagtttcatttttctgcatatgtatattctgtttttgcaacaccatttttattcaagagattgccttttcccccaatgtgtgttcttggcacctttgttgaaaatcagttgtttctgattatgtggatttatttctgggttctctattctgttcaattgatctgtgtctatttttgtgtcaataccatgctgttttggttactattgctctatagtaaattttgaagtcaagtagctgatgccttcagctttgttcttcttactcaagattgattcggctatttggagtcttttgtagttccatatgaattttaggagtgttttttgtatttttttgttttaccttgcagattcacctcaaaggatgttttttctatttctgtgaagaatataattggtattttaatagagattgcatcaatctgtagattgctttgggtaatatggacattttaacaatatttgttcttccaacccatgaacatagaatatttttccatttatttgtgtcctgtgttcgttctttcatcagttttttttgtagtgatctttctcctccttgcttaaatttattcctaggcatcttatatttttgtagctattgtgagataactttcttgatttctctttcagatagtttgctattggcaaatggaaacactacttagttttgtatattgatttttgtatcctgcagttaactaacacaggttcacgcttgtaccagtccagcttcctagtcatcttccattccgtatttgtatctctacagcaatgagaaatctgaaacctgagggagttggaaaggcttcttaatcagtcttcagcctctgtctttaggccttcgaatcatttgtgccttcccaagtgtttgttgttttcatacccttggcttttctcagatttagtggggcattaatttataggcaccctcttctccttgccttcacaacaactaaaccaacttcacaacttcagctaaaccaactatctatccccatcttcactacaccgtcagtaatttgttgacagctgtttaatgtgttgcttccccttctgtttttatgttcttttgagtttatgtatttttatattcattcattctcattttagtggggtttggggatgaagtactgataaatatagtgcagtacaccatatttagttgacataatttttaaagctgtcttctgcttttattacctccattttctaaattaaacaccttgttgggcttctcatcttgctttgcaattattatgggacagaagcatttcacattagattcttagctaaggcttctctcaaaagatatatttcattcttgtctgttacatcgtttagaatttacatagtttcatttgttagtatttcagtaatagtccttgcagtgctttactgcagattcaaccttcacaacatactgtaaaaacacaaacccaccactgaatccttgatcttgtgattggcgcttaatgccaccagatggcgagcatgagctcttgtcagacagttaaggcaagaaacttgaagtgggtgctttcttcatgttttatataatgaaactagaatacctaaatttgaaacagccagcttttgaaaaagctggtaatggttgtattgcagcagaaaatcataggctttggactcaaatggacttgagttccaatcctgcttctaattgctactctatggcgttaaacataagtttcatagtttattagagcttccttatccttagaactgggataatgataacttttttgtgtaattgcagggattaaatgaaacaatgtatggaaaacccctagcctagggactggcacttagtattcattaaacattaaaccactctctgtcacttccttttcttagagctcctgcttcctttcttatttaagagtttgtgtctaaaacgtggtaatacaatcttttgtaaaagtctgttgtaagctcttagcactgataaactcaacttaaaccacacatcatctctataaggtatagttaatgactaggaaaaaagctaatgattctctctttcccctccatttaaaatacatccaagagtgcacaaatgctaaatgatcacccaaatgttacacttcttttcattctgaatctttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcctggcctcaagtgaggctcctgcctaagagtagctaggactacaggtacacaccaccacacctgactttttttttttttttttttttttttttttgagatacagagtctcacactgtcgcccaggctgcaatgcagtggcgcagtctctgcttactgcagcctgtgccttctgggttcaagtgattctcctgcctcagcctcccgagtagctgggattacagatggacgccaccacgcccagctaatttttgtattttttgtagagatggggtttcaccatgttggtcaggctagtcttgaactcctgacctcaagtgatccgcccacctccgcctccctgagtgctgggattacaggcatgagccactgcgcccggcccacacctggcttattttgaaaatttttttgtagtgatgggggtcttgctgtgttacgcaggctggttttgacctgggctccagtgatcctcccatcttggcttcccaaagcttaggtatcttttcaaaaggctagaaagaaaccaaaatcgtcataaactctggatgacaagattatgactggcttaaatttttctggcttccattttttataaaatgtaacatgatataatcagggatgaatatgagagctggaatggccactgagtgttaactttgattcagatctctcaaatgagtaaactataattcaagaccattaaatgatttgcttagaattcactacttctgaccgggtcacgctggtaatcccagcacttcaggaagccaaggtgggaggattgcttgagcccctggagtttgagatcagcctgggcaacatggcataactctgtctctacaaaaaaatatgcaaaaattagctgggcatggtggcacatgcctgtggttcccaactactcagaaggctgagatgggaggatcacctcagcccagggaggttgaggctgcagtcctcacgccactgcacttcagcctgggtgacagagtgagaccctgtctcaaagaagaaaaaaaaatatccaccacttccttttcttgagctcttctttttttttttttcctcctactcccctttgcctccatccttcactcagaatatttttaagccaagcaagatactatgagatacagtggttaagcatatgaattgggttgcttttagggagtaatttgacaatgtatgtcaagtctttgggcattatgttcaacttctttatgcttgcagggttttgcatggtgaaaattataaaaattcagctgctaggatctttgatgtttaaaaaggtgaggggaggtaaaaacctaaatgcccaataataggaattaaactggtaaaataatattgtcattttaataatcagataaaatgatatagatgaatattcaatgacacgagaagatatttataaatattttattataaaaactattttaattggttacattatatgtcgctatgccttcagagtagagagaagtgacagtttcaacacaaactgaaaaatttgtaagataatggctgctatttctaggcctgtaaaaattcatttacccaaagaaaatcatagtttttttttttttttctggagatggagtttcgctcttgttgcccaggctggagtgcagtggcgcaaccttggctcactgcaacgtccgcctcccaggttaaagcaattctcctgcctcagcgtcccgaatagctgggattacaggcgcatgccaccacgcccggctggtttttgtatttttagtagagatggggtttcatcatgttggtcaggctggtctcgaacacctgacctcaggtgatctgcctgcctcagcttcccagagtgctgggattacaggcgtgagccactgcgcccagacctatttttcttttctttaaaagaagcttttacttaaaaaaaaaaaaaaaaattatcaaggtatttttttaatcatagggcagttaccttagatcatcaaaatactttccaaggttgattgactattaataaagttggaatatttggtagctaatgcttaattgtattttgggattatcttatttttcccccactgtgtcttttcaccgtaatttaaaattatgttttaatattatgacaaaaggacaaaagctctgcttgctttgaggtgaatgtacataggcacttaccctttttcgatgtttgctttttagggttcattttcttggatatcactacattcctttcagtgaagcaagccagttaatatatagtgtcagggggcaaacaataaagaggttagagggaagagtttataatttttttcttgttattttcagtcagaactacttccttttgaaatgtatttttttccatctccagtggctgagaggagagtatcttgatttgaggtccctgagtagcagatgctttgtattgagagtaactgattaaagagccctgttttttgtttttgtttttgtttattttttttttcttttttaatcattccaggtcttgtcatgtcttaggaagtttgagcctatagcccaactgagtggattgttattccatattagtatggtcttcaagatatcaaaagttaaatatgtatgaacacatgaattacattttcacactgtctctttttttcctccagatagcacaacgatagaaaaattaagagctatttgtttagaccatgccaaacttggagaaagcagccttagtccatctcttgactcacttttctttggtccttcagcctcacaagtgctatatctaacagaggttagtttttggggttttttgttgttgttgttttctttgtttttccttttaaatttattctgtgttctttaaatttgacctttcatatggtaaggtgaatgatttgggtaaaattgtaatgaagtagttttgaaatgaaatattaatttgaaataaataatagtgagatggtcaagagtttcttggcactgacaatagtacaaatagaagttattttttttttaaatcttttaatacagccctctccccctcttctctatttttccaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacaggtaatacagactttttaaaaatccttttataatagtagatagcaatttttaaagtaaaactaattagtattttaagtgtagagttcaaggttgactcaatgttcaaagtgccttatttcagaggttttctttatgatgtttgtattaaaagtgcaaatacttttcgctgacagctgataatctgagggtagtttctccctgcccacttaaatcttgcttgactttcatttattttaaacctaacaaaaactccatatgaatctcttattaacttgtgcctggtagatatataaagacacagattgtaataagagatataattggtttatcttgttgcttgtttcccttcccaccttgggcttaaacccaagttctgagcttattctgactcggtttctgccttggtggcattcttgatccatgtcacaaaaaattctcaagacatgccagaatttgatacttatttatgagagatcaaactatgcatttaattctaagtaaagttttataaacatcataaatgattgttttactaagttactgatagaaggtaaaacttcagggataaagattttcttctttagaaatggcttagttttcaattgtggagatcagaatgttgatatttatggtaatatcacatataattgttttagctatgataatactgtggttatgtttaaaaggaagagccccctatatttttgaagtgattgctaagatacttccaggtgaaattacatgatatctaggatttgcttaaaaacaatcctggggtggagaagtgatggaaagcaagggaggatagtcagattaaacaatttggttcactggcgataattcctgaagctaagtaatatgtacatgggagttaattatactactttcgacactttgatgtgtgttacgaattttctgtaaaaaatggcttaaattttatattgttttgtatcacaggtcccatctttgttaggatttttttttttttaaagtagttcttattaggtaagtaaaaagacagcttcttgttaggataaaaacagatttttgtcatgatccctgacacagatacttaatgaagtacacagaaaacaattacatgtttccactttcacctttcttcagtatttattcagagaatgtgccactatggatacagaggtacataataacctctaatctcaacgagctcacagtagggagcccaatgcaaacttagtaatatagaaatatcttaaaataatattgttgaaatatttacagtatatatatataggaggggagttacaacttgaaggcagtcagaattacctcgctaacaactacgtaatgaaattaatctgtcactgatttaacaacttgattatagcattaagtaaaaactagggtacctttcatacattagtcctcttactgctttttcagtattccttaatttttcttttttttttccaaagaaaaatgtggtaacaatggggaatacaagcagggtctgcccaaggcatgtacataaaagatgtacaatactttactgagtctctagaagggaaccagtctatttagtgtatcattatcccctgcaagttaagctgaggccagatttagagacacgagttgattgctctagaatggggatttgcagacacgtggcactacagtgcacaaggaagagaggaagcccactttgttggcagtgctttttgtgtaagttgccacaggttctataatgtgtatatgcaaggaagtcgttctgcaggagtgggtgatgaatgaagagcaattggttaggtctggttatgtacaaattatttactccaaataaaatggttaacttttttcagatcaaccaagttacccatgatcaagcagtggtgctacaaagtgcccttcagagcattcctaatccatcatccgagtgcatgcttagaaatgtgtcagttcgtcttgctcagcagatatctgatgaggttagttttatcaagacttctgtcacaattttaactttcctaggcccacttattttaatcactgtctcattctatagataatgtccccttaatatcagttttgtctactattaatattagtactttctgtttttaatcaactttatgtataataaacagcatccttttaaagtatacagatggggtgattttttttttttttgagacggagtctcactctgttgcccaggctggagtgctgtggtgctatctcggctcactgcaacctccacctcccaggttcaagtgattattctgcctcagcctccacagtagctgggattacaggtgccacacccacccccccatgcccggctatttttttatttttagtagagatggggtttcatgatgttggccaggctggtctcgaactcctgacctctggtgatctgcctgcctcagcctcccagagtgctgggattacaggcatgagccaccatgcccggcccagattcggtgaattttgacatatatgtgtgaaaccactgctgcggtcgaaaccgaatgttttcatcactctttatgcacttttgcagtttattctttccccaggtaactactgctctttttgtccctagagagtattttttgtcttctggagttttatataggtggattatagtgtgtgttcttttgtgtctggcttctttcactaagaataatgactgagaattacctgtgttgtgtggattagtagttcattcctttttattgctaactagtacccattatgaatattccacattttgtttatccatatacttggtgaaggacagttggatcattttccctttttggctgtgaataaagctgatgtaaacattgtgtacaagtgtttgtgtagacataaattttcatttttcttggataagaaactacgagtggaaaggttgtcatctttgtagtagtaaaatgtaatagtaaagagctagagaacttggggagcgtactttgttgtattgctgtttaaaggcaggaggtggggaataagccaggtgcagtggcagatgcctggacttccacctacttgggagcatgaggtaggaggatctcttgagcccaggagttcaaggctgtagtgagctatgatcacaccactgtactctagactgggtgacagagccagagggccctccgcccccacctttttttttttttttttttaagacaaaggcaacttgggaatttaaaaacaatggtactacacagtaattcctatttcctttacaaagtgaaacatttttgtttttctaaacataatttcactctcattctatcaacagttctatttactcgttatcttgcaggcttcaagatatatgcctgatatttgtgtaattagagctatacaaaaaattatctgggcatcaggatgtgggtcgttacagctagtatttagcccaaatgaagaaatcactaaaatttatgagaaggtaagaattatcacagaactatattccttgtaaacaaatgtttcttaattgtgcatgtggtttgatttttattagctttgctatttttaaaaattgaatcacttgcatcttaatggttgaaaattaattgatagctatgttgagaatatggtaaaattttactttgaaaatgaagtacttaagaatcgtgccatgtggctgctttttaaatgaaattgccttttgctgcttcttgtgggggtcagatataattgtctcatactgaatttgctttatcccattctcttttttcttttatcatctttctgtcctgcgtaaattttggtttgtcagttatggtatggcatttaagtatttttatttgattgtcttaaagcagtcaaaaataagagtgttagccaattagatatcattcctgaccttctattagattaagcaaattatctacagaagagaagctgtggttggctttttgatttatcatgtgtacctgcccctgatgctacatatttagaaggagaaattgagttacaggaacttccctgacttggtagagcttcttttacatggccaacatcaccctgatttgcccaggatatatgttgatgttccatagtatctgtctggcacagccctgggtattcattcagcttattaactgaatacttattctgtttcaggcatgtactgtagttactactttttgattaataaagtcagattagaattcattaggtacctccccaggcatattttaggttgtaagcctttgaaacccttcctgaatagttgtcagacaattgattttgaataaaatggcacaataggcaagcaacataatggaactagtcaaaagtacctaagtgctatgccacagtggttcctgagaaaggattggttgttggttcagaagtaaacaactcagaaggtctcaaaaagataggtagtgtgctcagtgtgctccttcagccctcctgaagacataggaaaataatggaattagactttattttctattatagtcatttccagactattccaaaggggcctcaagagttaacatgcagccatggagaggctgaggccaggtggtttaagtgagcagatgagttttaagcactaactagaagttgtgtgagatttttcttaaatacttctttgggtaatttgttcttgattgtaattttacagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaagtaagtatcttttttaattgtaagaaacttactttttgtaaatggagtgaattaatttaggctggcaaaatgtgtccccaaaattaaatatttattgtctctatggcatattggtattgaggaaaattttattatttaagagtgttttgcttaacctaaatgtttggttttagtctctgcaaatgccaatattaattgtcaaagcatgatttttttctaatcttagaatttagttttacctgggaggtatatagattagcctatttctaaaaatctagtttgcaagatttaaatcatataggacattagcctcctatcttagattcctagatgccaggttttttttaaagccaaacagaatttgatatgaaatttgtaagacagggtcattgtaagaacttttgcagtttacactgataataaagatcagttataaagctcatgttttcatttcaagagcatttaatcagtggcagtaattttgttttgggtttctttttctgcaagtcagtcagatttatagaaaatgttggtttccatcctcttgtatcagtctgatcctgatcttcgtatatggtaactttattaacttgggctctaatttgtgtcactgttgtatgtaattaacttgttttatctgtattttgtgaaaagacacagaaaatgtttactttcatcattccatcacatgccattcaataatgacaaaattcattgatgaaaggttgatgtaaattcacaataagtcatttgttgaaatgaaacatagtaataattaaagttttaaaaatgtacatgctgtggggggtagggttcaacttgcccactcgagaggatgtagagtctgaagtgggaatgtcactttagagtctaaagtgatttagtgggtttaaagtgtgaatatcacctattttaagaaggtccttgggtaagttctttgaagaaatccagtccagcctattcagaaactcttaacaggatccccacaaatcgggttgggcgtgctacctccttgagaagacaatcctgcacgttggaaaagataaataggtttagtaagtctaattccatttaatgatgcatacgtgtgggaatggtgaggataggaaagatgattagccaacagttttaatgatgtcaaacctggagggtagcaagtttgttattctatgttgaatttttaaaatcttaaattaggaacttatttcatctcttagtctactaactattaaggaacttgatttaacagggttttttgccctctaccctttatgaaaattacccttatataagtcagaaccattttgcccctctcttccctgaaacttgcatgcagtgcggtaatgtactgtagaaagcatgttatctcattatgtcaccatattgtctgcaataatagggagggcgttctaagttaggatctttttgagttttaagtacctgattttttataaatatctgaatacctatgtaggttcaaaatccattatttcccgttagtaagaatttgtcagcaagtccgacttggacattaattattggcattaatattctaaaatctgaatccccaggccgggcacggtggctcatgcttgtaatccctgcactttgggaggctgaggcaggtggatcacctgaggtcaggagttccagaccagcgtggccaacatggtgaaacctcgactctactaaaaatacaaaaaattagttggacattgtggtgggcgcctgtaatcccagctacttgggagactgaggcaggagaattgcttgaacccggaaggcggatgttgcagtgagctgagatcgcgccattgtactccagcctgggcaataagagtgaaactccatgtcaaaaaaaaaaaaaaaaaaaattgaatccccaaatacatactggccccaggggtttcaaataagggattgtgagctgtgtacaaatctgcccctcagatggagtttataatcctatagtaacgtttaagcatagttatttacaaggtacttctcacttaatccgtatagcaactcagaagtagactttgctgatggagaggcacaaggactgtagaaattaaatgactaacaagggcataatgatcactaaatgctaacactaagactgaaggttttctgcttcttgagttctgacatttctgccacacaaattgggctctgggtgtaattataatccaccagcaaatatgtgaatccctacctatgtgcttggcaattaaaaccaaagtcaaataaggcagttcttgcactcaaggaactttgagagagaaattggtgccataaaaggtaaaatactttgagaattggaaaggccataacttactttctacctggaaggagcaaaagtgaaggttttgtgcaggatgtagcatgtgagctcatgtttgggcaggatttatatgtgcataaaagtagaagatggtcattgccagtgcgctctctctctccctttctcactcccagttatgtggcttttacttcatgtgtctttgaactccatacactttcctcctcatggtctaccctgatctaagcagtctggacccattgcctggacaatcatagtatccttgatcttcccacctgtagtgttgtactcttctaatctgttgactacacggcaagcagagtgatctctagaaaatatgagcatgttgctttcctgcttaaaatctttccatgtcttcccgttatctttgaattaagttcaaacttttaaatttggcttataagcactccataatttggtccctgcttctactcattcagaagtttcaacttaaatgccacatattctagtaacttttccttatccctaatctaggaaaggtttcctagacctctgttcctgttagatggtctgcttccacatcatgacactgactttattttattgtagttagttgcaatggatttaaattcttttagataaacgatatttttttctgctgtttccacagcctgttgttttattccctgcctagttaactcacttatgttacctctctgatccgagaaagcatttgactttgccactcctgggatagtgctttcagagcagagctgagtatttggttaaatgtttagaaaaggagtcaaggataatactgtacaggaggttagtgggagtcagtttgacagaaggcctatggtgctaaggtctaagcagtgtttgatgttaatgtggtgtaggcagtctcatgtatatgtttggtaaatattgatcaaatacctattgtctacaagacactacccactgtggatatggcaaaacagacaaaatcttagccttctaggagcttacatgccaaaagggatgggggaagagaaggcatacgagaagtatatcagataggaataagtgctatgggggtgaaataaagcaggaaaaggggctgtgtagtacggggcatgagtggagttcatttttttatagggtagttgaagaagacttcacaaaggtgatagctttgtttagaggtcaccttttatcattacctttcagagcaaagtaataatccatgtgactcatggagaaagtatattttaagcagaaaaaacaacagatgtgtatgtccaggcatgtcaggaacatgcctgacatgtgaaagaacagcagggaaactggagtggatggaacagaggcggtaggggacggggacagttgtagggagtaaagtcagagaggataacaaacaccctgtgagggtttttataggtcattgtgaagacattgaccctaagtgagatgggaatctttcagagggttttaagcagagaaatgatgtgctccaccttaactttgtaagtttattctggttaagaatagtatgtaggatagcaggaaaagcaagctattttatgaatttaaataaaagatgacagtgggctgcatgcagtggtggctcatggttgtaatcccagcactttgggaggccaagacaggaggatcacttgaggccaggagtttgagaccagcctgggcaacatagtgggaccttgtctctaaagaaaatagaaaaaataagccgggtatggtgaacatgcctgtagtcccaactactcaggaggctaaagtgggcagatcacctgagcccggagaggatgaggctactgtgagccctgatcgtgccactgcactctagcctgggtgacagaacgagacccagtctcaaaaaaaatttttttttagctggatgtggtagcatgcacatgtagtcctaactagtcaggaggctgaggtgggaagattgcttgaacccaagagtttgaggttacagtgagctaggatgatgccactaaacagcctgggtgacagagggaaaccctgtctaaagtaaaagggactgactgttgtgaagatagaggcaacaggattagttgacagaaatgtgtttcttttgaagcactctagaagtctgcatttgctcagggaagttctatcgggtattcacgagcatcaactttttattgcccctcatatttgggctgtatacctagcttattgaaaaattagtaaaccaaagcagtgggaatagcatacctttgaaaatctgattaagttatgggcttgctcccagaaaagtagatacgcctgactttggtttacttgggttccccccaaattctacctccaaaaattttaggggcttctgaatccctctgatttataggcctatggactgttttcagaaacctaagataccctctagggagggaggttagtacacagaatgtatgctgtcaggtcctttacacttgtactttaaattaagttctgagggctgggctcagtgactcacgcctgtaatcccagcactttgggaggccgaggcgggcggatcacctgaggttgggagttcgagaccagcctgaccaacatggaaaaacgccgtctctactaaaaatacaaaattagccaggtgtggtggcatatacctataatcccaactactcgggaggctgaggcaggagaatcgcttgaacctgggaggcggaggttgcagtgagccgagatgttgccattgcacaccagcctgggcaacaagagcgaaactctgtgtcaataaataaataaaaataaatttggttctgagttatctagtaactagcacaaagacagaaatgtagttatccatgaaatgcagtttgtgatgtctataagatattcacaaatgcttagcaggtacttgttgagcatcttccatgtgtcatacattgttctaggtgccaggacctttggcatcaagaaagcccctacccttaaagagcttactttgtaatggagatagactacacatttgataactggttcttgaggtcctcttatacgccagacactattctaggttccaatggcacagttttaattaaaggtagatgatgtctctgccctcttggagcattttattctagtgagatctatatagtacataacagtttttaaaaaagatagatccatgattcccagatctgagaatcatgagacaaggttttcccaagggtcatcagagagaaaatatggtattgtgattctcaatctttcttttttctttcttttttttggagatggattcttgctctgtcaccaggctggagtgcagtggcgtgatctcagctcactgcaacctccgccttccgggttcaagcaattgtcctgcctcagcctcccaagtagctgggattacaggcacccaccaccacgcctggctaatttttgtatttttagtagaaacggggtttcaccatgttggctaggatggtcttgacctcttgacctcctgatccgtccgcctcaccctcccaaagtgctggggttacaggtgtgagccaccgcacccagcctgtggttctcaatgtttagtgcacatcagattgacctaaagagtttattaacacattgctgggccccacctccagtatttctgattcaggaggtctgcattggagcctgagagttggcatttctaacaagttcccagataatgctgatgttgctgctctggggaccgtgcttttggaactgccagtacggtatacggcagcagtccccaacccttttggcaccagggcccagtttcatggaagacaatttttccgtggatcagggaggtagtgggggatggtttcgggatgaaaggattccacctcagatcatgaggcattagttagattctcataaggggcacataagctagaacccttgcatgtgtagttcaatagggtttgcgctcctatgagaatctaatgccaccgctgatctgacaggaggcggagctcaggccataatgctcatttggccttctggcctggggtttggggacccctggtgtaagagacatctgccacaatagccttaccgtggttactacagaatttccacagagctgttgtgcagaaccacagttgaataaaaattctgtggaaggccaaaaagatgcataaggttattgtagtagagcatttggtatatagaggaacatttccagcctgttccaagaaagaggtgttagaaggtggtatccctcaaactcttagtgtcaatttgaggttatagtcctggacatagagcttaagttcatgtattatgtggtgttggcttgagtgcttgttgtgtgtaggtagggtaatcctgtatccttactattaatttatttcccttttatactccccccacctctcctccccaagagggaacaatgttacaatcattttttaaaatggaaataatgtattaaatgtgaaacattttttatttcagaactgttcgtcaggtggcacaggagcagttctttttaatgtgcaccagatgttgcatgggacaccggcctctacttttcttcattactctactctttactgttttgggggtgagactttttaaaatatgcttatcaatgtgattcattctttaagcaagaaacattcagaaatttgtggttttagcttgcattaaagttaggacagtctatatttaataaatgaagtactactttatttcccgcactgtggtagtcatcttctctagttaactctgggtttttaaaaaagtggattttgaggatggacgtgtaaattgatattattctactctgtttccagagcacagcaagagagagagctaaacactcaggcgactactttactcttttaagacaccttcttaattacgcttacaatagtaatattaatgtacccaatgctgaagttcttctcaataatgaaattgattggcttaaaagaattagggtaagttttagttaatactccatttatatgtcattattagtaaatagaatgttttattgatgatttatattttttgagcattttggttaaatggaaaactccaaagattgataaaagggaccaaagaatgtactctgcatcagtggacgttagtaatctgtgattcacaaaatgcatatctagtttagtaaaatgaattgcttacttgacacttgaaatactgatgttcagcttcttttattttagcattttgggcctttttgcaaattctaatttttaaaaaaagtattcttgaattgtttatgtcaaaaatgagtctgatagagcagaactttctaccataacatctgatactttttacttaggcaaaatgatacaagaatttatttctgaagagatttgtagtttttaaccttcaaattagcatttcttctagtagttcataaagccaatttctagaaagttctgaagaaaacaaagttgtttgaatggaaagacttaaggaaattatctcatatccctccagctctgtctcgttctggctcctctctccctctttacctccctttcataagctagacatttgatttcttcccccccccaccccaccccccgcctttggcaggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagtaagttctgtgttcttggttgtaagctacatatcataaccttctaaatgtttataatcaaatttaattaatttatagtagtatcatgtctttgtactttcttgatcttttctcttttttaagaatctttatcaaatttacagtaatttaagaaatacagttatgccttactttattcaagagacatttctaaatttgtatttaaataagatttcatggctggacttgctggcctcatgcctgtaatcccagtactttgggaggccgagtccagtggatggcttgagcccaagagttgaagaccagcctgggcaacatggtgaaaccccttctctacaaaagaaaaaaaaaaaattgccaggtgtggtggcgcacacccatggtccccagctacttgagaggctgagatggaaggatcacctgagcccaggaggtggaggttgcagtgagctgagatcgcaccactgcactccagcctgaaggaacagagcaaggccctgtctcaaaataaatagataaataaataagatactttataaagtaattgttgtttagtttttctctttggaaaatctgaattgttaatttcatttaatgaggcaaacctctgttttgtaagaatgcatcttgtatatctttaatgagttttttcatacatgtagtaacacaaggaaacaaagtttcatttttgtacattttatttctattcaaaatgggtttaatttgctatacacttgattaaaggagcaaacatttaaaataaaaattttgataagtactatattcagttctttcttaatatttacaaatttatttaacctgcgaaattaggtatgttagtgatagtaaatagtgttttgaaggaagatctttttattagaaaatctgagttttctgagatgtaatgagatcttaaattccaatgagtaattttaaaatgatttacttacaagagaactttttttttctaaaaatatatagcattgctaatatgtaatccctttttcaactttttaggaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactagtaagtatttttaatagaatgtgataattgatcatttcaatgtttcaaagttgttttcctgtttttctttcagaaaatatttccaacttacgtatttctttcagtaactagtttaacatttttagtgagtgaatgaacagttaagaccattataggccgggcacggtggctcaggcctgtaatcccagcactttgggaggccaaggtgggtggatcacctgaggtcaggagtttgagaccagcctgaccatggtgaaaccctgtctctacaaaaaatacaaaaattagctgggcattgtggtgcacacctgtaatcccagctactcaggaggctgagacaggagaattgcttgaacccaggaggtggaggttgcagtgagccgagatcgcgccactgcactccatcctgggtgacagagcaagactccatctcagaaaaaaaagaaaagaaaagaaaagaaaaaagaaaaataagaccattataagcagaccaccttgtatagaaaaaaattcaaacatttgttaagtggcatcctataagtggtgtcgccatttggcaagataaatttcatctcatgaaacctgtcataaaattcaaactccagattaaaaggtagccaaagtaaatgccgtagagtatagacgtaaaactttattttatttatttatttttttgagacggagtttcactcttgttgcccaggctggagtgcagtggcgcgatctcggctcactgcaacctctcgggttcaagtgattctcctgcctcagcctcccaagtagctgggcttacaggcgcctgccaccatgcctggctaattttgtattgccaccatgcctggctaatattgtatttttagtagagatagggtttcaccatgttggccaggctagtcttgaactcctggcctcaggtgatccacctgcctcggcctcccaaagtgctggaattacaggtgtgagccaccgcacctggcccagacttaaaactttaagttgcatgtattggaaaacctttcaggtcttcacttagaagttccgtaacgttatgagttcgaagaaaatctggctttgaagattagaacgtgagaagttaccattttggtgcaccttatttatgttctcatttaatgcccacaccaggcgcatgaataggctgcagatttcagaccttacagataaggaattgaagctcaaaagggcaagggcaatataaaatattaataacagaaaaagcagaaataagcataattgatgctgttttaagagaaaatcgctatttagaacacttaagaatataattgattatagtaaatctttaagaacatgtcaaattactttttgatgtgtttcagaatgtttggaagttttaaataacatctcaggaatttctgaataaattgattgcttaaaaggttagacctttagctgtcctatcaaatctatgtattgtgagaattcttgtattttttttttaacttaatgggggttaattttttaatcacagattggagtatagtacaacgttgtttgcatccttccctatctgccattgttccctgtcaacacagaaatatttacctaattccatttttggccatgcagtttggtatgatataattaactggccccctagacaatgatacttaatgttgtttccaggtttatactaggtggagggagataggaagatgtacagtgatttacaattatcacaaatctgctgtcttgcttgctcctcaaaatagcattatagatatcaggaaagcaagtgttacttttattattacatttactaggaagaaacagaaagttacctaaaggtgggggaaaaaaagtggtaagcatcagaaccaggatgtgagcccatgtggttttaggattatttaaaactgagaaaattataatgtgttgatatatttagataacatttcattccttgccaaatttgaaggcaaaagtatcaaatattaagaaagtgaataatggctaaaaataaagatgcaagtaaagttagcatgtagacattagaattatactatcttgtacttttgagactgccatagaagcaacatcatatgaaacgggtttgcgggtgattggataagaagctgcacagtggtgcctgttgctgtatattttagattgttggaagatgaagtgcaaactcagaacactgcttcaggttgctgtagggttagtcgaattatgggtggtagaattattgccagggttgctttgtcagcataatagagtttgaaaggacagaatggccgtgttcatgctacaagaatctttccttctctcagcttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgaggtaaatttgagttaccatttctgttttctgtgtttcaagttatgataccagatactattctctcttaagagagtgttatactttcatcaaacgtattaaagtatatttgaaagttagggatgggccgagcacacacctgtggtctcagctactcaggaaactgaggcaggaggattgcttgagcctgggagctggaggctgcagtgagccatgatcatgccactgcactccagcctgggttacagagtgagaccctgtctcagaagaaaaagaaaaagtaagtagggatggacttctcccagccagcatgaactgctacctcttaacatagtatagttctcactacctaccagaatttaaactgcagataatttttagaatggtttgtacatttctaaagcaacagttggctgggcatggtagctcacacctataatctcagcactttgggaagctgaggcaggtggatcacctgaggtcaggagttcaagaccagcctggccaacatagtgaaaccccatgtctactaaaaatacaaaaattagctgggtgtggtggcacatgcctgtagtcctagctactcggaaggctgaggcaggagaatcacttgaacccggaaggtggaggttgcgatgagctgagatggcaccagtgcactccagcctaggtgacagagcgagactccgtctcaaaaaaaaaaagcaacagttaatgtactcgtgtttttttgtgtagagtgtttagtataatttggggtttgtttgatggtaagaaccttcatttttgataatagttttaaatttttacttttctatttctaaattttaattttctattttatgccaagttatacagtatctgccaatttcactgtgtgtgcttacttttaggttattctttgaatttcccttagatcatagctcttcttgattaggaaacaaactttccctactttaaatagtctcacgtagtcttgtggcaaaatttaggctgcctactgagtatccagtgcagtataaagcagtgaagaagttgagttgtagtggcgaatcagaattgacataactgtaagatagctctttaaagaagagcatatggcaagaagacttaagttgtggtcatgtttgtgcttaccatgtaatatttccttggttttacttttcctgtttatagtgatagtgggaactgaagagagaagccagagtatattctaattgtagtaaatggttcttttcattccctcccttcagttgccagaactgattttgctctgaagaagtagtttatcaattggagcttctgaaacatctacttgcctcaactcttccctagacctgctgtgccagatggtctagggattgggttctgagcactttcactttataaaaaaaagcttcataaaggacacttatacccatacctgattaaaaaccactgctctgggaaaaaaatgtaattcaaattccagttctggagcccatcatatacctgggatattgagttaaacacaagtagatataggtaattgtactggcaagaagtaaatgaggcatagaaaatataacacaatttcaaataaggtgtaccacttttactctcatggtatcctctgctccatgttgtctctgcaccccagtgtactgtgggagtttttgtggggttttttgggttttggtttttttggcttatgtttttgtttccatccctagagtataagtttctcatgggcagggactggttgttgtctatttctatatcagagttatcagatacaactcagagaatactgaaagatagttaaatgtaaaaacacattcttctttgtagctgccatatgattatgacctttaggaattctgtcttcatgttacatcttacaccactacttctgttgttttttaaaattgtggtaaaatacatataacatgaaacttaccatctgtttttaaatgtgcagttgtcctattaaatacatttacattgttgtacaccatcaccaccacccatctccaaaactcttcatattgcaaaactcaaactgtagtcattaagctactccccattctccctccccacagcctctggcaactactattctttttgtctctatgattgactactctacatacctcatataagtgattatataagtgaaatcatacagtgtttgcctttgcatagctggcttatttcattttaaagtctaagtaatattccattatatgtatataccacattttccttatccattcatttgtcgatggacatttgggttgcttccccatttgagctattgtgaataaggctgccatgaacatggatatacaaatagctgtttgaggtcctgctttcaatatttccaggcatatgctcagaagtggaagtactagatcatttggtgatgctatttttattttattatttattatttttttcagacagagtctcactctgtcacacaggctggagtgcagtggtgctatctcagctcactgcaacctctgcctcctgggttcaagcgattctcctgcctcagcctcccgagtagctgggactacaggcacgcaccaccataccccgctaatttttgtatttttagtagagatgggatttcaccatattggccaggctggtctcgaactcctgatttcaggtgatccacccaccttggcctcccaaagtgctgggattataggcatgagccaccatatgcggccaaattttttgaggaactgttttctagagtgactgcaccattttacattcctaccagcattgcacaagagctccaatttctccatatccttgccaacacttgttatactcactcgttctggtagttgacaccctaattgagtgtgaggtagtatctcatggttttgatttgcatttaccaaatggttaacgattttgagcatctttagctgtgcttattattggccacttgttgatcttctttgtctatttttaaattgagttgtgttgttgagttttaagagttctctgtatgttctagatattaactccatatcagatatgtgatttgcagatactttcttttgttgcctgtacctctgatgtcatatccaagaaatcactgccaaatccagtgtcttgaagcttttgccctatgttttttttttttttttaacagttctgtggttttagctcttacatttaggattttgatccattttgagttaatttttgtatgtagtgtttcataagggctcaactttattcttttgcatgtggattatccagtttacccagcaccatttgtggaagagtactagtcatgcaccacataacaacgtttcagacaattacagaccatatatatgacagtagtccaatgagattataatgtcgtatttttactgtaccttttctatttttagatgcacagattcaccgttggtttgcagttgtctacagtatgtagtacagtaacatgctgtacaagtttacaacctaggagcaattggctataccatctaggtttataggtacactatgatgttcacatgacaaaatacctaatgatgcatttctcagaatttatccctgtcattaagcaaagaatgactatactgatataggtatattttattgacagatctgagcattttatatacaacagctacacaaaggatatattacccccattcacacataaagaaacttgaagcctagaaagtttaagtagtttttacttgctcaaagttacttggtttataagtggtagagcctgcatttatgtctagttcagtctaaattactatgctaatgctacactatattatctatctttcttacacatggtcagggttatttggttatgataactaatatgtgaaatggtggggataaacactaaataactaaaaatttataaattgaaaagtgctttggaaatgagcataataggaatacaaatcatttgttcaataactgcttggcatttgtctcaacgtattttattatactttagctcattggtgacattttttggtttctagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggtaaactatggatggacagtaatagagatacttcttaaaatgaacatctcaatacactaacattaaacctctaaaagacatgttggaaggcatctttttttaagcactggtaatattcaaactgtccttaattgggtgggtttttttttttttttttaggtccccttaggaagaagtagaaactgccatagtaagtaagggcaacatcctttagtctcttaaccatattattaactttttattaggaaaacatctaataaatacagaagtagaaaaaatagtatgaacccctgtatacttgtcacccaacttcagtagtagtcaacttgtggccagcctcatttaatctatattcttaacctattttttttttctttttttctttttctttttctttttttcttttttttttttgagatggagttttgctcttgttgcccaggctggagtgcagtggtgtgatcttggctcactgcaacatccgcctcccagattcaagtgattctcctgcctcagcctcccaagtagctgggattacaggcacccaccaccacgcctagctgattttttgtatttttagtggagacggggttttaccatgttggcccagactggtctcgaactcctgacctcaggtgattcccatctcagcctcccaaagtgctgggattacaggcgtgagccactgtgcccggcccctacctatttctttctagattgttttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttctgtttttcttggtcacctgcatcttctataaacaccttatgagatctagaggcttgatcagattgtggtattatttttctttttgtggaatggataggcaacgctacttcataggggataatgtttatctccatgaggagtgacattataatgtctgtcttcttatgatgttaacagcaattttttattattattattatatatatacaatttttttttttcccctgagatggagtctttgctctgtcgcccaggctagagtacagtggcgtgatctcagctcactgcaacctccgcctcctgggttcaagcaattctgcctcagcctcctgagtagctagggttaacaggggttacaggcgtgggccaaccatgcccggccaagttttgtatttttagtagagacggggtttcaccatgttggccagtctggtctcgaactcctgacctcaggtgatctgcctgcctcccaaagtgctggattataggcatgagctactgctccctggccttttttttttttttttttttttttttggagatagagtcttgctctgttgcccaggctgaagtgcaatggctcgatctcagctcactgcaacctctgcctcccaggttcaagcaattcttcagcctcagcctctcaagtagctaggacgacaggcccaccacaccccgctaattttttgtagttttagtagagatagggtttcgccgtgttggccaggctggtctcaaattcctgacgtcaggtgatccacccgcctcggcctcccaaagtgctgggattacaggcgtgagccactgcacctggccaattatcattatcttaatacagtatttcttcagggttataaaataacaatattttattttttcatttaatagctagaaaagatctataaagggaaaattgccctcaccattttctttttaagttagaaaactcagattacatttttatcttgtttcctttgactttaagtcagtactacgtcatgcactgtgctaaaataactacagtacaaccacgtaactcttactgtgtatgaaaaggggtataattctttatagcagtgaggtttggtttgttttgttttgtaagtaatcctccttggaatcccttcaaggtgcttcccggccagctgagaggagcggggaacgaagggtcacctgatactctgatccgccttcccttcttctgacaaagcagtataaatttcttttcctcccctaactaggccctctacttactctgtactagtgtcttgcgtggaccaccctccctcccatctctcattttgcttttagtcccgtcacccagcataccattctccctcctctctgactatttcagttctgtcttctttccctaggttattccaattccatctctgccttaaggctattttagcatttctgtttatgctcttccaaactgaagaacacaaacagaggcttatactgggttttttttttttttgagacagagtctcactctgtggcccaggctagagtgcagtggtgtgatctcggctcacggtaacctctgcccgctgggttcaagcaattctcctgtcttggtagctgggattacaggcgcctgccaccatgcccagctaatttttgtatttttagtagagactgggtttcaccatattcatcaggctggtcttgaactcctgacttcaggtgatccacccgcctcagcctcccaaagtgctgggattacaggcgagagccactgcgcccagctgaggcttacactttttaaactttcgtcttgtcattcagttacaattttttctcttgtaatgcctttgcttttttgacttttcagttactcgctgtgctagtggagctcggtttgtatagactagcactttggattatccacactttagacacataatctactcttgacacaagcgggttagttaactacacttcctcaccccactcttttattttgaaaagtttcaaacctacagaaaagatgaagaagaggtataattatcacctttatgttatattctttatgcggttttactaattaacattttgccatatttgcttatcttgccatatgtgtgcttggtttttggtttattttttttttaagttttgtttgtttgtttgtttgttttttgtttttttgagatggagtctcgctctgtcgcccaggctggagtgcagtggcgtgatctcggctcactgcaagctccccttcctgggttcacaccattctcctgcctcagcctcccgagtagctgggactacaggcgcctgccaccaatgcccagctaattttttgtatttttagtagagacagagtttcattgtgttagccagggtggtctcgaactcctgacctcgtgatccacccggctcggcctcccaaaatgctaggattacaggcgtgagccaccgcgcccggccttttttcttaagttgatagtgaagttgcaaacaggacgcttcaccccttcatacttcaacatatatcttataagagatcatatatcagaataaggcaattttcctacttatgtatgatacagttatatccaagtaatataataacgatttttaatctctaatattcatcagtatatattccgatttcccaaaagtggtctttataacttatctctctatcccaatctgatactcatgaaggaatcacaaggatttggctgttagctctttagttgccttttatgtaaaataatctccctaacttgtgacttgtatcgcactgaaatttttaaagaatccaggccagttgtcttgcagaatgtgttttttgatttgtgtgattgtttcctgatgattagctttatgttaaatgttgagggggtgggggcaataaaactacataattgatgttttgtgtttctcactgcactgtattgggaggcatgtgttatccacttaattattaagtgatattaattttgatttcttggtgtcttaacagatctctcctttataaagggtaccttttcccttttgaaattagttgattacatgtttgaaagtttgaggagttgaatatggtttgaaagtaaatagaacggactggtgtaatttccagtaatgaaacaagctgatttttaacaaataatatatttgattttaaacttactgtatacaaatttttacttgtgtaaaatataatagagatcagattatttgctatgtagaaaaggtttttacaaaagtataaacagacagttcttgcatactttaaaatgtcatttcttgcttagaacaaatacacttaaattctctatatacattattctgtatatacaaaatcaggtattattgatagtttccagcagtgcctgagttttagcagtatgagttctcatttttgtggtatgtagtgatggtgtcttttcttagattactcaagagattaactctagaacaagttaaacctttctctcttcacttgggaaaaaaataaatttaagagtaactagatctgatctttttactatttataatccaaaatttaagcaaaatgaaagaaataaaatagtgattgtaacatccacataagagtgagatccaccacctcatcttaatagtatctttaattggattcaaaatgcatgcatgtgtcataccacctgaagcaaccatccttcctggagccgtactatccatcaattacaccactagttttgtggcagttctttgccgctagagtactagttttactatgaggctcactctcttaccccactacattctacagggaaagcacattctttttttcctactttttccatgtaattgaggaataaaatctcggttttatatactgttgtttgtggtcttgttgcttttttttcccctgaaaaatatagttgtacatattgttctgtgaatgttacatgttacatgttttatttcattcatttcttaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtaagtactaattacacattgaaagtatatgttgtaccatgtatatactaacagaaataaaatttttactagtacttacatacaaaagtggagtatatcactgattactaaatacctgaaacagaatgatttatatactttgcataccttactgctgtggggcttttttttgtttttgtcagttaacttttagttccttctactctgcctgatctcttagccattttattatattatactcttacagtctctttcttcctttcctttcctttcctttctcctttttcttttcctttctctttttttttctttctttcttttttgaaagagacaaggtttctctttgttgcctaggctggagttcagtggcatggtcgtaactcatagtaactttgaacttgtgggctcaagcaatcctgctgcctcagcctctcaaatagctgggactacaggcatgtgccaccacacctggctaatttgtaaatttttttagagatcgaatctcttgttgcccaagctggtctcaaaactgctgacctcaaaatcagtcgtcacacctcaacttcccaaagtgttgagatgacaggcgtgagccactgcgcctggcctactcttacattcttttacagaagattattcctgaggaaataaaatggcattttgcatatagctacaggtgttatttataaatttgccctttatcttagaacttgagtgattataatagtgtaaatacagtaagtttagaagatgacaaagctatggtagtatttcctatacaaatgaaataatgacttttaaaatagcattgattattgtcattatctttaaggtatatttgtatacaaaacatatcaaacctattgtaaaaaaagattttacccccgtccgggaggtgaggggtgcctctgcccggctgcccctactgggaagtgaggagcccctctgcccggccagccgccccgtccgggaaggaggtgatggggtcagccccccacccggccagccgccccgtccgggagggaggtaggggggtcagccccccgcccagccagctgccccatccgggaggtgaggggtgcctctgcccggccgcccctactgggaagtgaggagcccctctgcccggacagccgccccgtccgggagggaggtgggggggtcagccccccgcccggccagccgccccatccgggaggtgaggggtgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttaggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcgccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcaagaaacacccaagaatgatcaattaaaaaaaaaaaaaaaagcctaaaaaaataaaaataaaaaaagattttacaagaaaaacattgacaaaacaaattgtttgacttgaaaattgattaagggcttctattagaaatagttaatgagttcattactgataaatatacatgcctgtcatatggaagttttactttgggacttgttataatatggattaatgttgatttgcaatcgtttttcaccaaaatgtcacagtaagatagtattttctacaatccaaactgtattaaatatagtcatgggttgagtacacatgtggtttgtgggggtgttttgtttttgattaccaggaaatgattgggtgagaggtaatactatataaatgagaaatttctagcaagttatagtcttaccactcattcataattagggaatatacttattcacttagcctaggcaacttttagtccttttgaaaggccttttatattaggtgaacaataaaataaaattttaaccttgtttttaattagtgataaaaacagccaactttggggtcatttgttcatgttactcctccttagttttagacaattttctaaattatttggaaatcactggttttctttggcaagtgaaatgtcaaaagattatggtcttgaaatcagatccttatacctgatcaacagctaaactagtcttatttttttaactagctgggcatgggggtggactcctgtagtcccagctgcttgggaggctgagtcaggaggatcgcttgagcccaggagttagaagttccagtgaactgtgatcatgccactacattccagcctgggtgacagagtgagacctcacctcattaaaaacaaaaaagaaagaaactctactttgagtgcccatacaaccattctgtttttcactctcagtacagtattcattgaattacatgaatctttgtgttacaagattttgcccaactgtaggctaatataagtgttctgaacacatttagggtaagctaggctaaagctatgatgtttggtaggttgggtgtattaaatgcattttcagcttatgatattttcaatttatgatgggtttattgggctgtagccatttcataagcaaagagcgtccgtacttgctgcagagaccatatgcttcacaaagcctaagataaatttactatctggccctttacagaaagactttgctgtcctctaatgttagaacaccttctttttatagatgttgaagaatatcctacttttgaagtgtagtctaagatctaacttttttccctctatgggctgttccctgattatatagtaaaaatttgcttaatacctgctttatattccattcatataatttataaatgcctttgtgtaccttttttccggagtttaaaattccttaaataagggactatcttaaacagtgaatatccctcagtacttttacacatagaaagcactctcagtctatccattggatgaattaatggttaataatgtattcctcacatcccttgttttgcatttatgcatgtgtctcaccagaaattggaaagtctctttggtagaaaatgaccataaactgggattctagctccttctcaggttgctaatcctgtactcatttgtgtgtgcaaacttttgctttactaaggcttccattacagaaaaggaagaatatataaaaatttagcttattcgtagtttatcattttcagaacttaataaattcatgctttggcttcagcatgaattactatctaaacagataacactagaagcagcatcgtatactacaaagagattaagctgtgagcccagacagattcaactttaaaataccatttcacctaataatcttgatcaagttaacttttttattgctaacattctatgacttacgggtttcgcattataaaaatggcaaatgtatgggtgcagcaaaccaacatggcacatgtatacatatgtaacaaacctgcacgttgtggacatgtaccctagaacttaaagtataatttaaaaaaaaaaggcaaatgtagtttacattaagtccataactaaaatgtttacaaaactaagggataaatcctttttttaaatcgtttttaggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggtacgggctgtccagttttgtttaattttgattacatttaatggatttagaagaaattggtttttttggttcatcctcacaagtcaccctatttttattttctcctactttggtatagtggtagcagagaagtagtcaatatgataactaatagaaggtttggcaaggaaggaaaaaaagtagtgccaaaggggctaggtaaataagataaaaataggtaaataagagtgaataattttaaaagtcataacgtgatagcacattctcttatataagttacacagacactttccatctctaccgagaaacaaattgccattgaacccctcaaagatacagagctgatagaggaaaacatttctcctgtcatgtccaggattacttgtcaagaccaaaacatttgctgaaaccattaattactttattgaaccacataagatttcttttagactagtcaagtggcccataagatttcttttatcacctatgttataaaaccatttattttggaaacttattagcagttctttgagagagatgattcacacgcattatagtaatgaataaggtgtatctttgggagctcccaaaccctttcaccctcaagtcacttgtgttgttttggccttatgcaccacttagagaagtcctgaagtttaaagattgagattgtgggctgtaaagccatactgcctgccacctgcagctcctgagacctgaggcaagttacttgacctctctgtgattactagttttcatcttttaaggttcagtagtacacacttgagaaggttgtaaggattcggtatgtttttacttgtgcggcacttagtatatattacctggcatctgaattacccaacaaatattagctactcttattgttattgtagttctttggtttgtgcataggaaaccaccttcgtgggaacaacagtaaacatcaaacaggtaataatggctagataacaatgacagaaaccagtcaacaatttaccatttgcatattattaatttcagcatttaaatcagctgataggattatcttgattatgctcattgtcatgtatttgtttatacttaaaaattcagataagtcttaatatcatttaaaagtttgcttggggtttttttttttttcctgtggattttaatagaacatctggtaactttgtcttgtttattttaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccggtgagtatcaagagagtttagcttcttagtaataaagaataatttatagtaggcgtcaacatgtttaagttcataaaattaatgttttcactttaaatgagtctaatttgctgggtgtggtggttcacgcctgtaatcccagcactttgggaggccgaggtaggtggatcacctgaggtcaagagttcaataccagcctgaccaacatggtgaaaccccatctctactaaaaatataaaaattagccaggcatggtggcatgcacctgtagtcccagctactccctgtagtcccagctactccggaggctgaggcaggagaatcgcttgaacctgggaggtggaggttgcagtgacccaaattgatggccactgcactccagcctgggtgacagtgagtctccatctcaaaaaaataaaataaaaaaataaatgggtctaaattaaagtagcctgagaagggttcttaacaaatttaggacttctcaaaattaatggaaacacagacttgtttgaaaatggggttggaaaataaaaatgtgtttttatatctgcattttatttatagggcaagatcacctgttgcctgaagcagaagaaatcactatgatcagtattcaacttgctgctaggttcctctttactacaggatttcacacaaagaaagtagtccgtggctctgccagtgattggtacattgctttggattttcattcctattatactaatgtttggtttgcttctttaatagattgctttatgtttttctaaaccaagagaattttgtttgaagtttggaatatagaataaaaactctgggtcacaatagagaaatcatattaaaatagttacttagtctaaacatggccttttgttattcagaagctgacttctgcttctattaccttgtatcatatctttgacatccctgcaccaaagactacaagctgagactgggggacagtgactcacacctgtaatgccagcactttgggaagccagggtgggaggattgcttgagctcgggagttcaggaccagcctaggcaacatagtgagacccccatctcttcaaagaagattttaaaaattacccaagtatggtggcgcacacctgtaatcccagctactcggaaggctgaggtgggaggatcgctggagcctgggaggttgaagctgcagtgagccatgactgtgccactgcactccagcctgggcagcagagcaagaccctgtctcaaacaaaaccaaagattacaagatgagactgaaaagtgtaagctacttatgaaatttattaggttttagcttacctagattgaattctgacaccgattaaaagggtaaaaaattaaaatggttttcttaagtttctaattgtgaaagtatagaggccattatgatacattgatttaataatttttacttactcatttcaggaatatgtcaagataagggggtggtattttgtcattgaatctaggaagagtttgttaatggatttttagaggacaagctttcacctgtttggtaactctgagagaatagaccaagtcatagtatttatctattgttttaatattagaagcaacctttgctggttctctccagcagtagaggaagatctttgtcttttttttttggttcaatgagactcatccttttactatagagaacaagttattgacttaatagtcataggtttttttgttttattttaggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggtaattgcacagctttctttctaaatgatgagatgtttacaaataaattgtgtttcctggaagtcgaagtcacaagcatatgtgcatccacttgatatgtttacctaacagaaacacacaatatgatgtcagtgagttccatttaatattactgcatggcaatgaatagtaattattggctctttaaaaatgtaagagaattttctctgttcggttacatgcagtagcttaattataagtttactgttaagtagattttttcctattttgaaggttttttaaatagtcttagatttttttaaaaaattacaagtgtaaaaaattataatgaaatccgcctctgatcttcattccctttcccaagaagcaaaatagtttagtttgtgtgatcagtccttccataaatgtatgcctgtatcagcatatgtgcatgtcctttttatgcaagtagaagtatacatataccttgttgctgtaaaacaggtaatgttttatcctttacaggcttatgacaacttaagcttgagtgatcacttactaagagcagtactaaatctcttgagaagggaagtttcagagcatgggcgtcatttacagcagtatttcaacctgtttgtaatgtatgccaatttaggtaagaatttaagtttttcagaattctgttttgatgtatcatattaaattgtgaagtcatttaggtcaagtgatgaaatataatctgatctgaagtagaaacaatttcccataaaacctgttgtgaattttatctgaacatggcactttcaccttttactttgtttatgcatgtgtctttgtggtagacacaggtcagaatctgtgttttgatttttttttttttttaatctcctaatgcagtggtgccaaatctggctgcttttggaaaatactggtttctaggcctcttctcacactgattgaatcagcatccccaaagctaatgtcagggaatccatgttttcaaaggggtccccaaatggttgtgatactcaccaaatttagatagcagacttggtctgtacataagtttttgtttaagtaaactacaattatggataatataaatactcgcttaaaatattaatttaggggccgggcacaatggcttatgcctgtactcccagcactttgggaggccaaggcaagaggattgcttgagcccaggagactaacctaggcaccatagggagaccctatctctacaaaataaaattttaaaattagctggatgtagtggcatatgcctgtagtcctagctacttgggaggctgaggtgggagaatcacttgagctaaggaggttgaggctgcagtgacccgtgattgcaccactgcactccagcctgggcaacagaatgagaccctgtctccaaaaagcaaacaaaccaaaaagtcatatatccaaaatgaagttctatatccaggcgtacctgtcgtttcaggttttttttctgtgatcttacttaatcaccattggatccatggcccttttaacataagggagattgtacttttcatttgtctatttagtttgtcttcttttcccttgtcttttccgtaattgcagatatttgggtatttgtagatgagaaagagaatatttattacacagacaagcataagtggaatctgtatttcaaacttaaaaatgccaaatttagacattcagaagaatcctattctgttcaactcttttagatattgcctgttcacaaagcacacatcattgttccataatgtaacctacttgtaaaattttcctgctgaaaacaaatactgtagggcctgtaaaccttaatatgaagtccttaagatcagatatgcattgggattgagaattgtttggatttaagaaaagcaaggcagtgcatataccaacatctctatagcagggtctgagacaacaacttacaattgaacacattaatatttctacagtaaaatatgaatatttatactgaagggagaaataaagactataagtagcctttagtcagtttgggctaggttatcccaccaaccacattttgacagcaacttaatgaaaaactttgttgggctgggcgaggtggctcatgcctgtaatcccagcactttgggaggccgaggcaggcggatcacctgaggtatggagttcaagaccagcctggcaaacatggcgaaaccccatctctacttaaaaatacaaaaattagcagggcgtggtggcgggcatctgtagtcccagctattcgggaggctgaggcttgaatctgggaggcagaggttgcaatgagccaagatcgcgccactgcactccagcctgggcaacagggcaagactccgtctcaaaaaaaaaaaaaaaacttgttataataatagcttttgggccaggcgcggtggctcacgtctgtaatcccagcactttgggaggccgaggcaggcagatcacaaggtcaggagttcaagaccagcctgaccaacatggtgaaaccccgtctctactaaatatacaaaaattagccgggcgtggtggcacatgcgtgtaatcccagctactcaggaggctgaggcagaagaatcgcttgaacccagaaggcggaggttgcagtgagctgagatcacaccactgcactccagcctgggagacaaagcgagactccatcttaaaaaaaattaaaaattaaaatagcttttggaatcttaggatttcagataagaggttgtggacctgtttttattatgtttttgggaatatggcaataaataagattgtctaatgggatatagaagcaaataatgtagttgccataaaatatgttaatagctataatagggaaaatgcaaagtgcatcacggggggcatggtacctgaagggatttggggagtgcagaagacttaatggggaatgtaacgtgggaattggttagttgagctttccatctagagtgtgaacagcagatgcaaagacttgataaacttggcgtggcttattggatgggatgaaaattgtccagtctgactagaattgatgtaagatgggaatggcaggagtttctgatcatgcagttctaataggccttgtgagagagactgaggcattggatgagccattgtagggttttgaacagataataccatctagaaagagcactgtggccacagtgtggaatgtattgcagtggagtaagatcccagagagtgttaaaatgatctatagacataagatcattgtgacctgtactggagaactggcagtgagggagatacaagtggacagatagatatatggtgctttttataagaagtggaatcagtggatttggtgatgggatattcagagaaggaggggacagggaagagatgtgaagaatgatgcccaaaattctaacatgaacaactgtgagtggatagtggtaccatttactgaggggaaacacaggaggagaaacatgtatgtatgggaagaaaggggtgagttcagtttgggtagattgagtttgagcctgtgtgacacccaaatggagatatacagtagaacagtaagtaatttgtcttgaaatgtttttgaatcatctgaatgaagatatctagaacattaaagccgtgagcgtgggctagatcatccagggaaatcagtgtgagaagatagcctggcatgggaacttggagaaacatcagtttttaagagacaaggaggagtcgcaaataagaacaaaaagaggtagaaagaaaatcaggaatccagggaggaagaagtggttatggtttgagaactgctccttagcttattactgtgaagaggggccaaaaccaaattggcatgagttgaggaatagaaaatgagaaagtagagagaccaaatgtaggtatctttttcaagaagtttggctgtagaggaaagaagagaggcaggcaatttataaaagagtttttgcttctcatttaatgtagttattttgttgttttcatcctccttacaaatgagggttgcagtgttggttagtccctttagactctccaggctgtagaaagtgttcgtcttctggtcgggcgtggtggctcataatcccagcactgtggaaggccaaggcgggcagatcatgaggtcaagatatcgagaccacccaggccaacatggtgaaaccccgtctctactaaaaatacaaaaattagctgggcatggtacgtgcctgtagtccagctactggggaggctcaggcaggagaattgcttgaacccgggaggcagaggttgcagtgagctgagatcatgctactgcactccatcctggcgagagagcgagactgtctcaaaaaagaaagaaagtgttcatcttccttacagtgagccggtgtgattggaatgtcatagtcatagtcactgttgaacaatgttaatacttatactcaatgggtgagttttcttttctagtaaaataattctctgaatgctaagtaaaagtgataaaattacaaatcaaaatttttctgatcataaaaattatagacaagatattttgtataactacttgttttattcatgaagcccttgccatcttaattttttcctcatatttttctccctctctttcttctccccttcactcctttttgttgtaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaaatttgaatgctccattctttacactagttttgtttgtttgtttgttttgagacagagttttgctgttgttgcccaggctggagtgcaatggcgtgatctcggctcactgtaacctccgcctccctggtttaagccattctcctgcctcagcctcccaagtagctgggattacaggtgcccaccaccacgcccggctaattttgtatttttagcagagacggggtttcgccatgttggtcatgctggtctcgaactcctgacctcaggtgatctgccgtcctcggcctcccaaagtgctgggattacaggtgtgagccaccatgcccagccctctttacggtagtttttaaatgctgctgggcatatatagtactaagagtctggaggaagatttttgctttggaatattttagccctgtaccttttttacgtgtttaatgggggtcttttttctgtctccttgtgactgaggttgataccatgtttatgaaatagtttaagaattaactttttaggctgggctcagtggctcatgcctgtaatccctatgctttgggggaggccaaggcaggagaatcacttgagctgaagagtttgagcctgggcaacatagcgagacttcatctctactaaaaattaacaacaaaaaagttggctgggtgtggtggtgtgcacctgttgtcccagctactcaggagactgaagtgggagaatcacttcagcccaggagatcaaggctgcagtgagctgtggtcatgccactgcactccagcctaggtgacacagtgagaccctgtgtccaaaaaaaaaattaactttttatatttagattttgtatttttatatcttggtatatctatctgatcattataatgcataatgttactttcttcgttgtgcttaggtaacttgatttaaaatgttatttctctaaaataaaacatttggccagacatagtggctcatgcctgtaatcctagcattttgggaggccgaggtgggtgggtcacttgaggtcaagagttcaagaccagcctggcaaacatggcaaaaccccgtctctacaaaaatacaaaaaaattagccaggcgtggtgacgtgcacctgtagtcccagctactcggaaggctgaggcaggagaatcacttgaacctgggaggtggcggttgcagtgagctgagatcgccccattgcactccagcctgggcgacagagcgagactccatcttaaaaaaaataaaaaaaaattataggctattttctatcgtgaaagttgtgtattattattgtgaagaagcttattagttttttattggtgacaaatctgtattctaggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggtaaaaggaaaataacatttgtatgtttataatttgatttgttattcctttcattaagttactcaccatgtcttacttgtttttaggttgcatattcctatacctatgaactgcggccctatttggatctgcttttgcaaatcttactgattgaggactcctggcaaactcacaggtggatactctttttgtgactggaaacaattaggcttgcccaggtgttagagttaactgaaattgacagtcaccacattttttttaacctattggagttctagtgaatgttttatcttaaacctaggacaagggtaaataacaggttctccccttttcctcagaattttatttccttttttattcttttttctcactgcctaagtttcatacttaataagcctgtttctttagaatgacttttttaattaaggaggagctagcttgggcatttggtaaatatttgaatttcattaatgatgcccgaggattattttatgattatattacatttgttttagaattagtcacttgaagcaacttagtcattagtcacatgaagtataatagtatatgtaaaaagtcttcaggtaagtacggtttccatttttcatggtacttatattctgtaaagtcaccacagacactgagttagcaaatactgaaccattactcctaggaggaaatacagaattaggtttctataagcctctgtttacatttttatcaaccagtcaatacataaccttgttgtatgtgtgtttctacttaaagtcatttaatatattttgttgactcataaagttcacagccaacagctctgtaacttaagcctgaacttaagcttctcaatgcattctgcataaggcacatcacagccttcttgtggttaggaacattagatagcacttcaacattatatacttgggtcattttaaacataaaaataaccagcaaaagcacaaatatgtggaaaatgtggcactaaatacaccatgaagaaggacacttgtttacagtttaagctgaaacaagagagaatgacactcttctggacttcagctaggaacgtttgtgttggacaacttgatatttttgctgctctgtatatgtccacagatgacgaagaaagcaccttgatgattgattttgcagttataaataaagtttaggaagtaagcgaattcacaaatgtggaattcatgaataatgaggggatcaattataattagtttttatgagaacttttagaatgttaacttttttcccccgtaaaaactaaggttatccagcttaactggccctcaaactttcactagaatttttctatttgtttttgggggtttttttgtagtaaaagttgaatatattatctttaatcccaagagttatataatagatgataaattatggtattagttgacagcactgccaggttttagaacttcccttcccacatggaagatagtataatagtttgtttgggaaaacaattcaaagtctatgtcgcagtttgcctcccatctgccaaggtaataaaacaaacttaaaaacaagttctgtaacaacaaaatgcttaaagagaagtaacaatctggagttttagtggggattgcgaaagccagaatttgcaacttagtattttcaaattatctccaaatttaccataatagatttcaaacaaatactgtaaaaatagcattaaaccaaaaatcaattttcgtgagacacaaaagatagtagctcagaattatagtcgtttattcaggcagtattcagtgcccttctaaatatgttcataggatttgaaagcttccttcagagtagattttaatgaaatctaacttttactattttcttttttaaaaatgctgtatttctgggcacagtggcttacccctgtaataagcactttgggaggccaaggcaggagaattgcttgagaccaggagttcaaggccagcttgaccaacatagcaagatcttgcctctatttttttaaaaaagaaagtactgtaagcacttacagttttaaaccagttaatcacatcttagctcttgtttgattagagcaagtgataatggcaaagacatacgtgctagattaaatgtgggaattacacttttgtgtaatgagattagtaagatactgttaaatgaatcactggcccaaacgtgaaaataattttctcataatgagcttttagttcattcagtaaacaatgttcaaatatttatagagtgtctaccatgtgcccagcactgcttggcatcaggtaataaggcaagtgaagatagtattaataaaaatggcatttgagagcagttgatgctaatggggagaaaatatgatatggcagaaataatgatttagcacttcattgttacttgaaaaaactgaaggtaaaagcaatttatatgtagtgtttcagatgaaacagcaagagggcctgaacatggttgatttgtctgaaatgattaagctttgcaaaattgttgaagtaatctgttttgtttggaaatcatgaatgcatttgatggaggaaaaaaatcttactttgactttaaacatactgttaagtaaaatacatagtgtatattagaatctttaaattctcagtgtccaggttatgttttctaattgaggtaaaatttacataacaaaactcaccatttcaaagtatacaattcagtgacttttagtacattcacaatgttgtatagccattaccactatctgattccagaacttttttttttttgagagggagtctcactctgtcacccaggctggagtgcagtggcgcgatctcggctcactgcaagctccgcctcccgggtttacgccattctcctgtctcagcctcccgagtagctgggactacaggtgcccgccaccatgcctggctaattatttgtatttttagtagagacggggtttcaccgtgttagtcaggatggtctcgatctcctgacctcgtgatccgcccacctcggcctcccgaagtgctgggattacagatgtgagccaccgtgcccatcccagaacatttttttttattaccccaaaaggaaacccctacccaattaagcagtcactcaccattccttctaaccctggcaaccactaatctgttctctgtctctgtggatttgcctcttccagacatttggtaaaaacgaaatcatgcaatttgtgtgtctgacttctttcacttagcttaatgttttcagagtccatccatgttatagcatgtatcattactttatagctgaataatattttgttttatggatatatatacaccacattttatttactggcacataatctttttaacacaaaagaaacaaggcatgtttgtgcccctacaatcatgttttaagttagttagttcagggaaagacaggactagttggctttgtattattactctgttgtagtttgggagaaactgaaatgaaatcctgtgttattggcaaatcagccaaattgtactattgcctgtcaaaatgctttgcctgccatgtattctcattattagaattcaaatactgtacctccaaattatgtcactgaatcctaacttgccttcagagatgcagttttataaaaggtattgatgtgtagcaaattaccctcaactacagcagtcataaacttagttataacttttttaaagtttgcattactctcgagtgtcctgaattcacttcaggtaatgtgtttaaattacatatatggcagaattattttggactggtaataagttagtaagagcacagactctggagtcacactgctccgcagctatatgacctcggcaagctgtgtaactctgtgccaattttctcacctgttaaaagttttaataataaggccaggcgcagtggctcatgcctgtaatcccagcactttgggaggccgaggcaggcggatcacgaggtcaggagattgagaccatcctggctaacacggtgaaaccccgtctctactaaaaatacaaaaaattagctgggcgtggtggcacgtgcctgtagttgggctgaggcaggagagaggcgtgaacctgggaggcaggacttgaagtaagccgagatggcgccactgcactccagcccaggccgtctcaaaaaaaataaataaataaaaaataaaggtttaataatagtacctattgtctaatgttagattaaatgactaaaagacattattgagtggcacatagtaggcactcagtatatattagctattagattttagatgtttttattttatatctggttctctttcagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcaggtgaggatttttttcttataattttgtagaaatcttaatcagaattaaggattctgttttaaaagaagagaatcatgagaacttggggttgtcattttaagttaactttgaagtattccaaatcctcttatctatatggttttattttcttttgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagtaattctttattttataggccagtgtttatgtattaatgatattattaaaagattatgttgaagttttgggttttgaaaaatgtttattcggctgggcatggtggctcacgcctgtaatcccaacactttgggaggccgaggcaggcggatcacctgaggtcaggagttcaagaccagcctggccaacaaggtgaaatcccatctccactaaaaatagaaaaattagtcgggcgtggtggcaggcgcctgtaatctcagctacttgggaggctgaggctggagaatgacttgaacccaggaggcacagattgcagtgagcggagatcgtgccagtgggctccagcttgggtgacaagagtgaaactccatctcaaaaaaagaaaagaaaagaatgtttattctatgtcattttaagctaatgaagggagctttcttttggagaaatttctgtgaaattgcctgaaatgtagtagttctgagagaatgcaaatcaggttttttgttttgttttttttttttttgttttttccccaagttctttatctgcagtaaaagaaaagttgctaatgggtcagttttgtagatttttaaaatttatttcaaatagaaaaagttaaaagtaaacttgagtttgcctacgtaattttttatcttgaaatattcaaaattaggagccagatgaccaagatgctccagatgaacatgagtcgcctccacctgaagatgccccattgtacccccattcacctggatctcagtatcaacaggtaaacaggagtcagtttatgcttttatcccctagaactgggttttatgcttaattttagaggatggctcaattgtttgttgtgactacaaagtaagaagtaggattatctagactagctttgggagcatgatccagaagagggatggtttggagtgggggtcatggtgtaacatgtttgaacttaaccactgtagggttttccttgtcaagaaggtgtccttcttgtgctagtagttaataaaactgtatgagaatttatatcaacataaaatgatcattgtttagtgcaaaggattgtggtgacatttccggtgaggtaaaatcttcacctggattccaaaaacattattaagatatggcaatgaagtaagaagtccttggttacttagccacaggtttcagtgatggtaaaaatcactggaaaaaaaaggatttgggtagatttccataggtgattaaagtaaataaactagtaaatagcaaaagaaatgagatgaagaaacattctaaatgataactttttctttctgaaaccaaaatgtgactaaatcagctcttgtgaggcagtggtactcaaacttgcacaggcgtgagtctccctggaagggttgctccagcagagagctagatgctaccctaaagtgtcttatttcataggtcttcaaggggctggaaaatgtacatttctagcaagttcccaagtgatgctgctggtggtccaggaaccatacttggagaaacatttcaggcattctttcttacatttcactgtgtacatagaagcaaactgaatagttaggaagtacacattcagcgtacttattttcatctatagaaagtaaagcctggccaggcgcggtagctcatgcctgtaatcccaacactttggaaggctgaggcaggtggatcacctgaggtcaggagtttgagaccagcctgaccaacatggagaagccctgtctctactaaaaatacaaaattagccgggtatggtggtggcgcatgcctgtaatcccagctactcaggaggctgaggcaagagaatctcttgaacccaggaggcagaggtggtggtgagtcgagatagcaccattgcactccagcctgggcaacaagagcgaaactcccatctcaaaaaaaaaaaaaaaaaagttaagcctaaaatcttggcttggctgatggagcatgtacagaaaaatgagagcactgtagggttcagacattttaaaaggttaaggaaccaaatccacaaggaaggttaacttcctttgaccctgagaaagctcttatgttaatcatgcctggttactttatcatcttgaacattgttctgtttttaatcagcattattgtgagttcagggttactgctcctatatatcttacatcatggttagtcaatcggatttagcatgtggaagagtcaatagatgctcatagatcattctctgaaaattttttaccaagagcaacagtgggttaatcctttatttgccagacttgagtctaaataatttttggcactaaaaatcactttggccaaagatttatgtggacctacacaatcactgctcttattcagggttttggggtttgcatttacactacgtttttcaagcctttttttgtttttgtttttgtttttgttttgcactatagtagtccaagggtatttacagagtaagtcccaagaataagagtatacatttccagagacttcagaccatgattttgaagttgttttactatgtgaaaagttttaacatacagatcttttctcctttcccagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtaacttgaatgtgtgtaattttttggaacctgtctaaaaaccaaatacccctgcaaacagatacagcccaccctattctatttaaatattttgctgttttattttatagaaattattttgctgaattcacaaatagaatttgatttaagaagaactttttgtcctgtggtgtgtttttggttttttttttggttactttttttgtcctttttttttttttttaaaagaggactgcatattaaaattcattctgtgcatagcatgcctaggcatgacactgattcaggatttcagtcacatcaagtttttgtgcacagaaagatttgacctttggccctctactgaagattttgagaaatcaggatgttgacactgtaaaagtttcctaacataatcttgtactttttgtatgttttttatatacatgtatatttaatgagcacaagcttggttgtattttttacaattcagttaatagggaaatgttttgtcaaaaggctacacttggaactgaacaaagcagaaacaaaattgagcattgcattattttgtgattaaaaggggcaggtatttaagataaagctttgggtatcttatttgtagtactgtatagtcaacctgtgcttctaggtgttcctgtaggacattttgacaccgatactttgagtgaaagtcacacacggtgtttgcaattccaactgatttttgttttgtttttatttttttgttgttttcttctttgagatggagtcttgctctgtcacccaggctggagtgcagtggcacaatcttggctcactgcaacgtcgcctcctgggttcaagcgattcttccgcctcagcctcccgagtagctgggattagaggtgcccaccaccacgcccagctaatttttgtatttttgtagagacagggtttcaccacgttggccaggctggtcttgaactcctgacctcaggtgatctggccgcctcggcctcccaaagtgctgggattgcaggtgtgagccaccgcgcctggccccagttgatagtttttttaatttaaaagttcctcaattccaagctctttaaacgagtgaaataggttaactttatttggatgagttaggtgtaccatctcaccatctgagaggagatttatatatttcctgctgctccttaacaaaatatgtaatgtacttaaaaactttaacgacttcctagttgagagaaaacttgacatataaaaggctgtgaatttttctgcttggaggaagagcccaaccttggttgctttgaagttacaagcccccttgtgccaggtgaggggcttgtgagtcatttttgtctccatttgaggaagagtggtattcgttgtgactaggagcaagggaaagtggagttatttttgtttgtgcaaattattttctatatttaactcaagcattaatgtataaccagaaatttaaagatgcatgttgttgcaagagcaacataatggtgattttgaggtctttttctgaacacaagtggcacattttaaatttcaagtcttcaaagtgcctaaggattatttagttctccctcaactgattttttgagccatatatttcctattttaaatgtttgcggaatcgccagtcttcctttgaaagaaacagcccccagaattctaaatgacacgattatagaagacagtagaatgtgttaccataaagactgaagatattttagttgtaaaaccatgtgaacaagggcttttgccctattgtatctaagtatttcagtgcacaacttgttaaaccatgttgctgctgtttctaagccctccaccaactgaactttcatgtttagcattgtagaggcagaaataacatactaggttttttttttctttcattgatttttctcctggtgataatttcccagccttgtgtcttttagctgttgtgtatacaaatttagaattaaaatgttttctatttttttcatgattaacttagtgaataacttaaatccttaatcctcgtagtggttagaaagatgaggagacttttttgacttacatttgtaaatgaaaacaagtctgtgaatattcagatgactacttcgaagtaattcagtttttttattagtatttttccagcttatgttttcccatgagctattttactttgctgaattttgtgggtaatttggtggatatatcctgccttatttaggattatagctggataagaaaattgccttttcattgtaagtgcccagttttggtctctagtttgaaggtactacatactgccgataaaggaaaacactcccctacaccccagtttttgtgttaccaagaaaaaaaaaacagtattggtttcatagtaggactcaaccagaattggtcctacatatatgtgagtgttcagtttttgcaaataaggtttttgagtgtgataaaacactacagaagtgctaagtgtattgagaatttgctgctgattgtatttataacaattacttgacgtttgcagaaatttagcactttccctccaaatttataggtgtaagagaagcgggggcaaggtgcaccacattttaaaactgcaaatgtgtgaaaatttatttagagattcagattcctaaaaggaaatttcaccacccaagtcatgcacttcttagccttttacaagccaacagactgacatgaagattgttcacagttcctaagatttagcacatatacaaaaataaaactttataaattcaatttcggttttccctttatttattaatacaagatttctaaacaaggtagatgtgtaatagagctgaagggaattttttaaagggaaatgtttatgaggaattcagccatcattgtgtatatccaaagtggattcacacctaaggacctcaaagaaatgagttgtgatctaattgcagactttagagttaaaactaagattcagcaaactgtggtgtttcagttctcttaaactggaaataaagcagaccacatgttttgaggggagccacagaagtgaaagttaactctctagcaagttccatctgctgttttttagtgtctagaaatagctctttgttgtcatgtcccagggaaattaagatttcctcagaaacctggaggtgctttcctaaagttgggttacttcaagaactgctaaaagacaaatctcagattttcactggatttaatttcactgatttttttaaatagaaaactaatatttaacttttctgcaatttggaaaactccctccagttggattagactgtattttaagtatttttagctacatgagtacatctaactgaaaatctacatcaccaccaatattttgaattgtttcttgtaatctggtaacttagagataggcaaaaagttgacatctttatttttatctgtacctgaaagtttagatactcttactaaagttggggttacataaaacgtttcagtaactttagggaggtaaaatctcaagagaaatttcttaaattacaccaaaaaactttcctaaatagaacacgtttcagagccatttaaataaaggttgattattttaaggtcattctatttaaatggtcaaaactcaagagtaaaataggaatcattttagccatctgagaaaacaagtctcattctgatccattaacattagacaatatactgcatttcaacaaatccaagatgccattggttacaaggcgcctcagcaagcaaaatcactgactttcatggatattaaaacgtggggtatcccatctggtagtaatccttgtcatgacaaacgtcttttcacatctggaaataggtttttgtagtgggcttttctcacattgcttttttttccattagtggaacttagaaaccctatttttatgtgtaattgctaacaaagctggccaatttacaagtttatgaagaaatggcttgatggaactgaacctttgaggagtcaccgaattattaatgaagtgccctgtgtaagcggtcttcttgagatagttttgtgtcgtagcttctggttttcacatgcattatagttaagacaccaagtggactttcttgctctgccagtatggttcagctgccctggactagtctctgcctgtcaaagcactccctatgttagaaaatgagtatagaggccaggcgtggtggctcacgcctgtaatcccaccagttggaaaggccgaagcgggtggatcacctgaggtcgggagttcgagaccagcctggccaacattgtgaaaccctgtctctactaaaaatacaaaaattagctgggtgtggtggcgcacgcctgtaatcccagctactcaggaggctgaggcacgagagtaacttgaaccagaggcagaggttgcagtgagccgagatggggccactgcactgtagcctgggcgacggagtgaaactctcaaaaaaaaaagaaactggcttctgtagccttcccagcactagccaaactcctcaaaggtaagcaagtgggggccaccttgcaagatagtaagaattgtgttcattttctatttatattcaaccctatagatgtgtttaaaaaacaaaatattccaaataggtactttgggtattggaacatttttttccatggagtcctttttagcaattcagttgcatcaggaatagaaatgtattcttaacagtgttgctgctgtgtctcttaaatcacttgccattaattatcttatgttctcatctaattcttcccccacccattaaaacattggtacacctttggagttcagaagtaaggatgattttggctgggtcttaattcccatgctgctgggaccagagagaagaaaggatatgcttcatggaggttcagaattgcattcccttctgacccaccaactactgcctgcacgatagctgttaacaagaggaagcatttgcaggatgtcaaggaaatgagtcaacatttagggcacatggtatgttgagggaaagtccttcagaatccattttcctcaggtgtctatatgtttaggatgtggcccttatttcttgatgtaaactagtgttttctgctgggtgattaaggaaacaactttttcaggctgtgtttaaaatcagtcagaaacctagatgggactgcttaaatttggtaagttagtaccattaagttgggtttttgttttgttttgttttgtttttgagacaaagtctagctctgtcagcagtggcgcaatctcggctcagtgcaagctccacctcccagggtcacgccattctcctgcctcagcctcccgagtagctgggactacgggcacccgccaacgtgcccagctaatgtttttgtgtttttagtagagacggggggtttcactgtgttagccaggatggtctcgatctcccgaccttgtgatctgcccacctcggcctcccaaagtgctgggattacaggcgtgagccaccgcgcccggctaagttggttttaaataagctcttaggttgtagttagccttttctattgctccaagattggattttttagttttcattttattttattatttgttttttgagacggagcctcgctctgtcgcccaggctggagtgcagtggcgtgatctcagcgcactgcaacctccacatcctgggttcaagagattctcctgcctcagcctcccgagtagctgggattacaggcgtgtgccaccatgcccggctaatttttgtatttttagtagagacagggtttcgccatgttggccaggctggtctcgaactcctgacctcaggtgatctgcccaccttatcctctcaaagtgctgcgattagaggcgtgagccactgcacccaatccaagatcagaatttttatctaacagaaaaacaaaaaacaaaaattcagacttgcactaaaatggtagcaggtttgccttactaatggccactgaagcttggtttaataacttagtaacgttaagtgctagataaactggatgttgggttgttgtttagcacttatcagcacagcgttagacactgatattagcaggcctggcgcggtggctcacgtctataatcccaacactttgggaggccgaggcgggtggatcacctgagatcaggagttctagaccagcctgatcaacatggtgaaaccgggtctctactaaaaatacaaaaataattagccgggcatggtggcgggcacctctaatcccagttactctggaggctgaggcaggagaattgcttgaaccggggaggcggaggttgcagtgggccgagatggcgccgttgcacttcagcctgggcaacaagagcaaagttccatctcaaaagaaaaaaaaaaaaaggaagaaagtccataaaccccacccatgttcaaggggaggggcatctcacattggccgggcacggtggctcacgcctgtaatcccagcactttgggaggccgaggcgggcggattacctgaggtcaggagttcgagaccagcctgactaacatggagaaaccccatctctactaaaaatacaaaattagccgggtgtggtggtgcatgcctgcaatcccagctactcgggaggctgaagcaggagaatcgcttgaacccgggaggcggaggttgcagtgagccattgcactccagcctgggcaatgagagcgaaactctgtctcaaaaaaagaaaaaaagaaaaaaaaagaaatggctacaggatgtccctctcattctgtgtttttgtctctagaaaaggatgataaagtaaccaagagtgacacttatattatcaggtgcttttgaggagtaataatttatcaatatgcaatccacatttaggcttttaactgctgttccgctatgctgaagtgcaatgggcaatactcatcacaaaagcagcttagagctgtaaacaaaaaagaggaattacttttagggaagctggtttaactgtacaaatttaaagtcaagaattaacttaagatttaaggctagaactaaaagaaagcatatataacgtcatacctgaatctcctactaaattctgaagtttggcattaggttggtttgaaaacagttgttaaaacgtgg

SEQ ID NO: 890 - DNA, 597 bp, mus musculus; identical to SEQ ID NO: 126

SEQ ID NO: 891 - DNA, 4732 bp, mus musculus
tggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggccagtctttctgtaggttgcggcacaacgccaggcaaaagaagaggaaggaatttaatcctaatcggtggaggtcgatttgagggtaagaccatctggggaccctaggagggacgggggtggcggcgggggtggggagaaggcagagaaggtaataatctaggtacatgtctgagtccgaatgtgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagt

SEQ ID NO: 892 - DNA, 53201 bp, mus musculus
cgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtgaacactggatacgcgacctggtcatgggaggcgggcggtgagaaggagagagagatgggtaattggaatggcacacaacaattaaaaaaaaatgatctaccttttgctagcttgatttccatacactcggttcacctcagaccatgcttgggaagaaaaaggttgcagcttctagcagggaaaaggcagactagatgaggaagagagggctacttccacaggcgaggacagttgtctggggagccctgagagggagagaatgtaaaaagaggttgtaaatgtttgataatcaaggctctggatttgaaaagggtctcatgtcttggttactggtctgaccattaataaccacgtctctctctctgtcttttcatttgttctttgggtgtgtatcacgcgtttttatgtgtaaatctgttcctaagtttgcagcactccatgtttctgtaaagatctgtaggggacagcagacctcaaggggagaggagaaggaaaagaaaattggcctggtttgtacagagtgggcagtacttgggaggcagtacttggaggtggtagatggctaagattagagtaggcaggagtgtaagggagcctccagaactctctgccagctttcctaacatgtcctcccttacccgcattatgttgcagaaaatgataggctttgggagagaggaaggaaacataggaacccagatgaaatatggaaataaatacttttcattttttccccagcctccgtggtttgtctaggcatttcgtccctactaacaccactactactaccttgtagggatgtttgagttgtctctgtataggaattgtcagactttgagaatagagcagaggggcttggagatttaggagtgggagaaaaaggggagatagaaaatgtttgccaaacaggtacttatatccagaaagaaactgtgccctaggtgctggtctctaccaaaaacagcctcaactgtctcctgtgtcttcatttattggtctctgtttttgtgaatccctgtaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtaaggaggagaaagttactccagatcagtgcaggttggtatgagtgtggggattgcctgggtagacctgtaggatggagtagtggagagctgcttggctccagcaggggtcaagaaccactaaagggattcctcagcttctcatccagttttcctactccttatgctcctgtttggtgactggaaagaaggctgatggcacttggaagtgtagggagtgggtgaaatgaagggagagagagtttgctaattatctacctctctcacctagcactgaatcaccatattctcctgtctccctgtgctgatcagcatgaggagaaaaaagttggaagagactcaaagccccatttccttcctccacccctaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaatattgtcctagttcttcagctgaaatctagtctggggggataaagcacagagagcataaagatggtgaagaacactgcctgtgtgtctgtagtggggcacaaacaaaacaagttcacattgacagattatttagtttcgacatacttaaaaagtagaatcactctatgcaagaaggcaggactgtgctattagttgtctgtaggctcctactgatagggcttcaaatgaggaatgaagccctatctgggcagctctggggaagggagtaaggaggaagggaatacagatgctttcattgtagtctcagttccggaacttgtgctcagcttttcacataaaatgtctcatcaggatgccttgaagctttttaaccccaagaggattcctggttctcacccctattcagtaagccatggacagctgcacaggaagtgtggttctgaagggacccagccccactgtgccttcaacagctccctccctatccaggggtatcagatttactgcttcatctgtgattctctcccccagaagtcctgggcctcagaggagagtctttctggggattacctactgaaactgcttcatagataatctcgtctgtctcatctggtgactgtttactccttacctttgttttctggccaatgtttggacttggtgatttgtaccacagttggtagcagccccttgtttgtgctgattctttttggtcagagctcagctctatgtatggcatagccacaggataccaaattcctttagaagtgcgtagttaggaagaaattaattcccataaaacccactgttctgtctattcgcatagtttatagagctgaagccatgttgtctatactaagcttgtcctgtttattcttaacaaaagctaggttctctgcaaggatttgtggaatagaatgacaatgtatagtttaggattttggggtcacctctgcctctcctaccccctgcctcttttactgttaatttactgcccagaattgggaaatataaatattaggatcagtatacaaatggtctttctgttgaccttcctctcctaactttttatacatttaggggaaggtctaaagtggaaaatctcaatatggtgtaatggatccctacttttaatagctatctgtagtttaatttctactaggatcagttgtgaatctattgtggtacatctaaaagtttaaatgaagcacagttagctacacttgtgcattaagggaaacaagcaaggtagtttttttgcaatgtgaaacttcaatttagatgatttttgaagttctttataacattttttaatccacagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggtgagtgtggggtgtgtacgtatttgtgtcaaagcacaaagttgatggtctctccttggatgggaattgtgggatgcgaagtcatctcctagattgttcatgaggtgtcatctgttgatggacacttaggttgtttccatcttttggctcttatgaatattgctgcagtgaacattggagtacaagtatctgtttgagtccctgatttaaattcttttgggtatatacctagacgtggaattgctgggttgtatgatttgtttagctttttgaggaattaccagctgttttccacagtgcctgtaccattttacattcccgtcagcaatatgcaagggttccaatttatccacattcttggtgacacttgttattttccattattatttaaatagccatcttaggaggtgtgaagtagtatatcattgtggttttaatttgcatttcccgaaagtcttatgatgttgagcatcttttcatgtgcttattggccatttgagtatattttttagagaatgtatgtttacgttctttgctcatttttaattgtgtttttggttattgttgcattgtaggagttttaaaatatatatattctggatacatgccccttattagctatgtgatttgcaaatattttctcctgttctgtaggttttttcacttttgatgatgtcatttgatgtgcaaaagtttttaatttcaatgaagcccaatttatctatttttttcttttgttgctggtgcttttggtgtcatatctaagaattcatcaccaaattcaaggtcacaaagatacccatatgttttcttctaaaagttgtatagttttaaacatcagagtaattagtgtttctatcacctcaaacatttatcatttctttgttttgggaacattcgaaatcttttcttgctatttgaaaatatataattatttattgttaactgtagtcaccctacattgctatatagatcattagaacttattcctcctatcttgctgtaattttgtatctgttaaccaacctttcccaccccattcctttccctatattctcttaacttttaattgaaaaaaaaaaaccacaataacttttgcaccatcctaatagtaaccactattctacactctacttctatgagatgagcttttatagcttccacatgtgaatgataatatgtggtatttatctttctgtgcctggcttatttcatataatgtcctccaggttcatccatgtttccaccaatgacaggatttctttcattgttatggctgaatagtggtctgttgtgtatatataccacatttttttatccttgcatctgtttatgggtacttatattgattccatatcttggctgttgtgaatagtgctgtgataaacatgagagtgcagatatctctttgatatactgatatcctttctttttgatacatacccagcagtaagattgctggatcatatggtagttctatttttagtttattgagaaatctccatgctgtttttcataatggctgtactaatttacattcccacctacaatgtataagagttccattttctctgcatccgtaccaccatttgttatttttttttgtctttttgacaatagccattctaactggggtgtgatgatatctcactgtggttttgatttgcatttccctgatgattagtgatgttgagtgttttttcatataatttttggccacttgtatgtcttcttttgagaaatgcctattcagatcatttgccaatttttaaattgaattatttgtgtttttgttgtttagctgtttgagctccttgtgtagtcgtgttctacacaatgtttcagtcaatgatggactgcatgtatgacagtggtcccataagaatataataccaaatttttgctgtaccttttatatgattagatacatgaatacttaccactgtcttacaattgcctgcattattcaatacaataacattctatacaggtgtgtagcctaggagcagtaggctatactatgcagcctaggtatgtagtaggctataccatctaggtatttgtaagtagtacttttcttcttctaagtagaagagcttttttgcccttcttcttttagaagatcttaagaaaatctgaatctatgatagtcttacaatggtgaaaatgcctaaggacacatttctcagaatgtatccacatggttaagcaatacatgactatatattctggatattagtcccttgtcagatgaatagtttgcaagtattttctcccattctgtagattatctcttcactctctgattgtttcttttgctgtgcagaagctttttagtttgatatcccatttgtctatttttgctattttgcctgtgcttttgaggtcttatccataaaatcattgcccagaccaatgtatttctcctatgttttctttttctagtagtttcatagttacatttaggtctataatccattttgagttgtgctaggaaacctggatatccatatacagacgaatgaaactagacctctgtatctcatcaagtactgcagaattttgattacagtagttttgtagtacattttgaaatcaggaagtgtatgtgctccaactttgttcttctgcttcaagattgtttttgttattctaagtccctttccattccatgtcaattttagagtcagcttttccacttatacaaaaaagtctttggaattttcacattgaaattttgcttgggggtattgccctctttataatatttagtttccaatctataaagacataatgcccttccatttattttggtctttaacttcttttagcaatagtttatagttttaggtatgtaagttgttcacctccttagttaaatttattcctgggtatttcattcttttatatgctattgtaaatggaattattttctttctttttcatattgttcattgctggtatatagaaacataactgatatgtgttgattctgtcacttgcaactttgctgaatttattcactctagtagtttttttgtggattcttttgaaatttctatctatagggtcatgtcatccatgatagaaatacttttatcttcttttttcttatatggttaccatgtatttctttttccggtctaattgctctggctgtaacttgaataacagtgcagaaaacgggcatgcttgtcttgttgctgatcttcccagtgaaagctttcagtcttttactattgaatgtgacattagctgtgggattttcataaatgtcttttatcatggtaaggaagttcctttctgtgcctaactttatgagtgtttttttaaaggatatcaggttttatcaaatatcttttttgtatcaacagagatgatcatgtgcagatttttttgttctattcaactggtatattacatcgtttgactctcttatgctgaccacccttgcatttctaggataaatcccacttggtcatggtatataatctttttaatatgctgttggatttgttgtgctgggattttgttgataatttttgcatctatattcataaggaatattggtacgtaatgtttccttgtgatgtcttcatctggttttggtatcagagtaatgctggctccgtagaattagttagaagatattcccccttctactttttagaagagcttgagaaggattgttgttgactcttctttatgtttgttggaattgtctagtgaaaccgtctggtcctggaattctctttttggggaagtttttgattactggtctaatttcctcactctttatgggtcagttgagattttctattcagttcagtgtcttttctattcagatttggagtccgtttatataatttacatatgtttttaagaatttgttgatttcatctaagttatctaatttttggtgtataaatgttcattgtgtacttttaatcttttaaaatttctgtgtggctggtaataatgttccccctttctggttttagatatttgtgtcttctttttttgtctctagctaaaagattgtcaattttctttatctttttgaagaaccaacttttggtttcattggttctctctgctgtttttccgttctctattttgtttatttctactcgaatctttattatttccttccttcagttagctatgggtttcatttgctcttctttttctcgttcctcaaggtgtaaagttaggtaattgatttgagatctttcttattttttaatgtaggtgtttatagtataaacttctctctgaccactgcttttgctgcatcccataagtttagttatgctgtttttgtttttattcatttctgagtattttctgattttccttgtgatttcttctttgacccattggttatttaagagtgtgttgtttaatctccatatatatgtgaattttttatttttctttctggcgttgattcctagcttcatccattgtcaatgaagataatttcacatgatattagtcttacaaagttcattgagacttattttagaagaatgtgtttttgctattgtttggtgcagagttctatatatgtctgttaggtctagttgatgtataccactgttcaagtcctgtatctctttattgatctcgagtctagatgctctgttcattattaagtatggggtttgaagtttcctactattattataaaactgtattttttctcttcagttctgtcagtgtttgcttcttcttagggactttcgctttcctacttatttaattctcctgtattttaaccccactatttttataggtttccccatatctgcatggaacatataatcatttttcccttgggaggaaaaaaatccttttcctaacactaaactcacacttttccagctatctttctcttcaccctttcagaataatcaagttttccgcatttgttgtttctgctttctcatttcctactcagtcctcacacaattgcaatctagtttctttctccactactcaactaaactctgcctcagaacttggtgccctgtgtcctagctacttcaactccagctgtggctaaaaggggccaaggtacagctcaggctgttgcttcagaggatgcaagccccaagccttggtggcttccacatggtgttgggcctgtgggtgcacagaagtcaagaactgcagtttgggaacctctgcctagatttcagaagatgtatggaaatgcctggatgtctaagcaaaagtctgctggaggggtggaaccctcatggataacctctgctagggcagtgtggaagggaaatgtgggattggagcccacagagtccccactggggtactgccttatggagctgtgaggagagggccaccatcctccagaccccagaatggtagatccactgacaccttgcactgtgcacctggaaaagtcacagacactcaacaacaagcctgtgaaagcagctgggagtggggctgtactctgcaaagccacagggtcagaactgcccagggccgttggagcccacctcttgcatcagcataatccaggtgtgagacattaagtcaaaggagatcgttttggagctttaagatttaatgactgccctgctggatttcggacttggatggggcctgtagccccttcgttttggccaatttctcccctttggaacaggagcatttacccaatgcctatacctccattgtatctaggaagtaactaacttacttttgattttaacaactcattgacagaagggtcttgccttgtctcaaatgagactttggactgtggacttctgagttaatgcctaaatgagttaagactttgggggactgttgtgaagacatgattgtgttttgaagtgtgaaaagtcatgagatttaggaggggttgggatggaatgatatggtttggctctgtgtccccacccaaatctcatctcaaattgtaatccccacgtgttgagggagggacctgtaatccccacctgttgagggagggaagtgattggattatgggggcggttccccagtgctgttctcataatagtgagtgaattctcataagatctgatggttttataaatggtggtttttcctgcactctctctctcacctgctgccatgtgagatgtgcttgcttcccctaccaccatgattgtaagtttcctaaggcctcctcagccatgcagagctgtgggtcaattaaacctctttcctttataaattacccagtctcaggtagtatctttatagcagtgtgagaacggactaatgcagccatggagtataatttttcaaatatgctgctgaatttggtttgctagtatattcttgagaattttgcataagtattcataatagatattggtttatggttgttagttttttcttatagtacctttgactttggtaccaagctaataggaagtagcccctcttctttcattattttttaaagagcttgaaaaggattcctgttaattctcctttaaatgtttagtaaaatttactagtgaaacgatctggtccagtgtttttctttgttgggaggttttttgattactgatttgatatcctcactagttataggtgtattcagattttctattacttaattattcagttttgctaaattgtatgtttctaggaatgcatccatttcatctaggttatccagttttttggcatgctgttgttcatagtactcatactctttttttgtttctataaagtggtaataatatttctgctttcatttctgattttattaatttgagttctccgtcatttaaagtcaatctagctaaaggtttgtcattaaaaaatattttcaagtgctgacttttgatcttactgattttccttgttgttttctactccatatttatctccattctagtgtttattatcttctttctgctggctctaggcctagtttgttattctctttcggattccttaagatgtatagtttagttgttgatttgaatttttctttttctttctttttttttttttttttgagatggagtcttgctctgtcgcccaggctaaagtgcaatggcacgatctcggctcactacaacctccatctcctgggtttaagccattctcctgcctcagcctcctaagttgctgggactacaggcatgggcatgcgccaccacaccaggctaatttttgtatttttagtagagatggggtttcaccatgttggccaggctggtctcaaactcctgacctcaagtgatctgcctacctcggccccccaaagtgctgggattacaggcgtaagtcaccacgcccagcctgaaattttgttatcttttaagtctaatgcttattatctccttattgccttcaatttcactgaattctgctcttttatgatttctttgttctgctcaatttggatttaatatcctcttcttgttttagtttttaaaggtggcatgctagataattaatgttattgatacttcttttttctgatatatctattcaattctacaaatttactgttaagcactgctttatttgcatgccgtaaattttaatgttatattttcattttgatttattttaaactattttaaaaattttctcttggtagttcttctttgatttatttgttattcagaaatgtgttgtttaattttcaaatattttggatttgacagctacatttctattattttcttgtttaattccattatggtccaagaacatacactgactaatttgctcttttaagtttgttaaggtattttttgtggctcacaatatggtccatcttggtgtctgttccatgtgatctttagaagaatgtatattctggttttagatgaaatattctacagatgtcaattagaaccagttaattattggtgctattcagtacaactgtgtccttactgcttttctgcctagtggatctttcaattactgagagtgttgaaatctctaattatcatagtggatttgcctgctttttttttgcaatgctatcacattttgcctcccatattttgatactctgtctttaggaacatatatagtaagagctgttatgtcttctttgacatttgacccattcattattgttgaagtctgcttttttcttttgattcttttgattagtgcttgcatcttatgtcttagtctcctttactttcaagctatctgtgtctttatatatatatagtggattgttattgacaacatatagttgggtcttgatttttttcattcacccctaaagtctgtcttttaataggagtattcggacaattcgtatttaaagtgattattgacatatttggataaatgtttaacacatttgtaactattttatgtttgttgccatgttcttagtgttgtattttgtaatccactttgtttccgtcttctctggttttaattgagcatttaaaaaattattccatttattttgttctcttagtgcattaattatacaagctgagtatccctgttttgaaaatttgaactctaaaatgctccaaactctgaaactttttgagcaccaatgggactttaaaagaaaattctcattggattttggatctcaaattttttgtattagggatgctgaactgatataataagtataatgcagatattccaaaatctgaaaggaaaaaaaaagctggaatcttaaacttttctggccccaagcatttcggagaagtatttctttttacaattttcttagtgattgctctaggtttgtcatatacattagcaactactctaaattcagtttcacataacactatactgattcatgggtagttcacatacctcatgacaaggtgttaccaattcttctctctcatcctttctaacattgttatcattatttcaaatatcaataagctgtaatcactgaatacattgtttctattgttattttgaacaaattattgtctattagatcaattagaaataagaaaaatatggttgactgttgaacaacacaggtttgaactgcacaggtccacttatatgcagattttcttctgcctctgccaccccaagacagcaagaccagcccctcttcttcctcctccttggcctactcaatgcgtagatgataaggatgaagaacttcatgatggtccacctccacttagcgaatagtaaatatactttgtcttccttatgattttcttaatagcattttcttttctctagcttactttgttgtaagaatataatatataatacatctaagatacaaatatgtgttaataagctgtttatcagtaagatttctgatcaacagtaggctattaatagtttgggaagtcaaaaattatatatggatttttgactgtgcagtggggtcagcacccctaacccctgtgttgttcaagggtcaactgtaaaatatttgtaaatttcatttatcccttcttcaacaatctttttttcctatgtagatctgactttcttacctgtataattttccttctctctgaactacttttaacatttctggcaagagaggtctactggcaataaattctcttaattttttaaagcacttctaggagactgtcaggaaacaaatccagcaagcttattgttttatttatgaaaacaaatcctcatttgaatgtcccaaatcaaatggtctttaaatacaaagactcacaaccagagttaaaaatttttacatagaacttattgaagtagttaatcatggaagttaatcataattatgttttcagataaagtgggtggctcttaaaagtgactttgagttgggtagaattattgctgaggaagctttatgctttctgtctacgaatgtggcatgtaagctcgatgttcttgagcatgatagtcactcagagtggatggcgcacagattgatgttctcaaagagccccaccaggtaggcctctcacacttcctgcagctgctgagctttggaagtgcaggttggtcttgaagttctgtgcgatcttgtgcaccagatcatggaatggcagcttgcggatcagcagctcagttgatttctggtagcagcggatcttacgcagggccactgtgccaagctagtagctgctagggcttatttatgcttctggtgctggagcactcttgcgggctaccttggtggccagattttttttttgtttgttttataatttttatataacattttaatgttttataattttttatataacattttaatgtcttataaaaacaaaattatataacatttttctaggtgaacttattctttgtgttcctgggatgtctatagacaatgttacagtaacttttgactacagatcattttttttcaaatgatataatattgataaagtattgtagggctcccaaaataaaatgagttggttttgagcctatggatgagaaatctgctggggaaatggtcaaattttatgtatttttttttattatactttaagttttagggtacatgtgcacattgtgcaggttagttacatatgtatacatgtgccatgctggtgcgctgcacccactaactcgtcatctagcattaggtatatctcccaacgctatccctcccccctccccccaccccaccacagtccccagagtgtgatattctccttcctgtgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcagcacactacctgacttcaaactatactacaaggctacagtaaccaaaacagcatggtactggtaccaaaacagagatatagatcaatggaacagaacagggccctcagaaataacgccgcatacctacaactatctgatctttgacaaacctgagaaaaacaagcaatggggaaacgattccctatttaataaatggtgctgggaaaactggctagccatatgtagaaagctgaaactggatcccttccttacaccttatacaagaatcaattcaagatggattaaagatttaaacgttagacctaaaaccataaaaaccctagaagaaaacctaggcattaccattcaggacataggcatgggcaaggatttcatgtccaaaacaccaaaagcaatggcaacaaaagacaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactagccatcagagaaatgcaaatcaaaaccactatgagataccatctcacaccagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtctttgtagggacatggatgaaattggaaatcatcattctcagtaaactattgcaagaacaaaaaaccaaacactgcatattctcactcataggtgggaattgaacaatgagatcacatggtggccagatgttgacatggcagtttacctccagtagacttgtgtgtagtctgcttgatgtgggccatttcagattaaccaaagaaaaaacacagatttggtctcaaattatgtttgtctgaaagtctttatcttctacactttagaaggattattttgttgtatcagtatttcagattggtgtgtttttttactataacattttagatattccactccactctcttcctgatggcatggtttctgaagataagttcaacctaattcttagccttgctcttctgtaagtaaggcattttttttcttttggcttctatgaagattttatcttaatctatgaagattttgtctttcattttctgcagcttgagtataatatgtctatgtgtaaatttttttggttaaattctgcttagtgttctgtgagcttcttggatttgtggtttggcatctgctatggtttgaatgtcccctccaaaattcatgttgaaattttattgcaaaagtaatactgttgggagttgggacctttaagaggtatttagattgtgaggtcttcaccatcatgagtggattaatgccattatggagggcgtgggttagttattccaggagttaggccctctttttttctttgtctcacatgctgacttgcccttccataatgttatgatgcagcaagaagaccttcaccagattcagccttttgatcctggacttctcagcctccagaaccatgaaccaaataaattccttttctttacaaattacccagtgtgtgatagtcttttatagcagcagaaaacagaccaagacagcatctgtcattcagtttgcaaaagtttcagccattattacttcaaatggttgtttctttctttcttccccttctggtatcaccattatgtgtgtgttacaacttttgtaattgttccataattcttggatattcttttctgtgttttttcttttggtttatctatttattttatttattccttcctttttattcttgtcagtttgaggactttctactgatatagttccaagctcaccgattcttcccttgactgtccaatccactgatgaaggaatcctttagaggtattcttcatttcagttacagtgctttaaatttctagcatttccttttgagtatttcatataattttcttttctttgttttttgtctaacttttattttaggttcagtggtacatgtacaggtttattatataggtttattatataggtgtattatctgtacacttgcaccacaggggtttggtgtacagataattttgttgcccatgcactaagcatagaaccgaataggtatttttttaaattatctccccactcctaccttcaaccctcaagtagggcccagtatctgttgttccctgctttgtgtttatgtgttcttgtcatttagctcccacttataagttagaacatgtgatatttgattttctgttcctgcattagtttgctaaggataatagtctccagctccatcaatttgctgcaaaggacacaatctcattcattcttatggctgtgtagtattccctggtatatatttaccacattttctttatccagtataccattgatgggcgttaagattgactccatgtctttgcttattgtgaatagtgctgcagcgaataaatgcgtgcatgtgtctttatggtagaacaatttatattcctttgggtatatactcagtaatgggattgttgggtcgaatggtcattctgtttttagttctttgaggaatcaccacactgctttccacaatggctgaactgatttacactcccaccagcagtgtgtaagtgttcccttttctgtgcaaccttgccagcatgttatattttgatttttaaataatagccattctgactgctgtgagatggtatctcattgtggttttgatttgcatttctctaatgatttatgatgttgagcattttttcatgtgcttgttggccacatgtatggcttcttttgaaaagtgtctgttcatttccttcacccactttttaatggggttgtttgctttttgcttgtaaatttgtttaagttccttatagatgctggatattagaccattgtcagatgcatagtttgctgatattttctcccattttataggttgtctgtttactctgctgatagtttattttgcttgcagaagctctttagttaacttagttctcttttatcaatttttgcttttgttgcaattgcttttggcatctttgtcatgaaatctttgcccgtttctgtgtccagaatggtatttcctaggttatcttgcaggatttttatagttttaggtcttacatttaagtcttcaatccaccttgagttgatttttgtatatgatgtaaggaagggatccattttcaactttctgcatatggctagccagttatgctagcaccatttattgaataggaaatcctttttccattgcatgtttttgtcagttttgttgaagatcagataattgtaggtgtgtggcattatttctgggctctctgttctatttcattggtctttctgtttttgtaccagtaccatgctgttttggttatcgtagccctgttgtatagtttgaagttgggtaatgtgatgccttcagccttattcttttttcttaggattgcctttgctattcaggttcttttttggttccatatgaattttaaaatagtttttgtctaaaatctcaatggtagttaaatagtaatagcattgaatctgtaaattgctttgggccttatggctattttaacaatattgactctatgagcatggagtattttaccatttgtgtcctctctgatttctttgagtagtgttttgtaattctcattgtagagatctttcacctccctggttagctgtattcctaggtattttattctttttgtggtcattgtgagtgggattacattcctggtttggctctcagcttggatgttgttggtacacaggaatgctattggttttcctatgttgattttgtattctgaaactgctaaagttgtttatcagctcaaggagcttttggtcatagatgataaggttttctagatacagaattatgttgtctgcaaacaggggtagtttgacttcctctcgtcctatttggatgccttttatttctttttcttgtctgattgctttggccagaacttccaatactatattgaacaagagtgttgagagagggcatccttgccttgtgccagttttcaaggggaatgctttcagcttttgcccattccctgtgatgttggctgtgggtttgtcatagatgactcttatcattttgcagtatggttcttcaatgcctagttttttgaaggtttctaacatgaaggggtgctgaattttatcaaaagccttttctgcatctattgataaaatcatgtggtttttgtcttgagttttgtctatgtgatgaattgcatttattgattagcatatgttgaaccaaccttgcatcccaggaataaagcctacttgattatgatggattaggttttttatgggctgatgtttgctagtattttgttgaggatttttgcagctgtgttcatcagggatattgacctgaagttttctcttttttgttgtgtctctgccacttttttgtatcaggatgacgctggtctgatagaatgagttgaggaggagtccctccttctcaattgttttggaatagtttcagtaggaatgatactagctctttgtacatctgatagtatttggctgtgaatcagtctggtcctaggcttttgttggttggtaggctatttattactgattcaatttcagagctcatcattggtctgttcagggattcagtttcttcctggttcagtcctgcaaaaatgtatgtattcaagaatttatccatttcctctggattttctagtttttgtgcatagaggtattcattatagtctctgatggttatttgtatttctttggggttagtggtaacatctcctttgtcatttctaattgtttggatcatctcttttttcttctttattagtctagctagcagtctatctgtcttactgattttttgaaagaagcagctcctggatttgttgattattttttatgacttttcatgtctcagtctgcttcagttcacctctgatttgtctattccttatcttctactagttttgtggttggtttgctcttgcttctctatttcttctagttatgatcttaggttgttaatttgagattctcctaattttttgatgtgggcattttatgctataaatttccctcttaacactgccttagctatgtctcaaagattatggtgtgttgtatcattgttcccattagtttcaaggaacttctttacccagaagtcattatttactgaaaagtcattcagaagcaggtggtttaatatccacataaatgaatgattttgagcaattttctttgtattgaagactattttaattatgctgtggtctgtaagtgtggttgatatgatttcaggttttttgaatttgctaaggattgttttatgttcaattgtgtggtcaattttaaagcatttggcatgtggcaataagaagaatgtatattctgctgtttttggatggaaagttctgcagatgtctattaggtccatttggtcaagtgctaagttcaggtcctgaatacctttgttaattttctgccttgatgatctgatactgtcagtagggtattgaagtctcccactattattgtgtgggaatctaagtctctttgtaggtctctaagaactgttttaatgaatctgggtgctcctgtgttgagtgcatatatttaggatagttaggtcttcatgttgaattggaccctttaccattatgggttccaaaaaagactttatcttttttgtttttgttgatttaatgtctgttttgtctgaaattaggattgtaacccctgcttttttctgttctccatttgcttggtagatttttttccattcctttattttgagcttatgggtgtcattacatgtgagatgggtcttttgaagtcagcataccattgggtcttgcttctttatccagcttgccaatctgtgccttttaattgagggcatttagcctgtttacattcaagtttagtattgatatgtgtggatttgatcctgtcatcatgatgttagctggttattatgcagacttgtttgtgtgattgctttatagtgtcactggtctgtgtacttaaaagtatttttgcagtggctggtaacggcctttctttttcatagttagtgctttattcaggagctcttgtaaggcaggtctggtggtaacgaattccctcagcccttacttgtctgaaaaggatcttatttctccttcacctagtaagcttaatttggccagatataaaattctgggttggaatttcttttctttgagaatgttgaatatagtccccaatctcttctggtgtgaagggtttctgttgagaggtccactcttagcctgatgtggttccctttttaggtgacctgctctttctcactagctgcctttaacattttttctttcatttcgatcttggaaaatctgatgattatctgtcttggggatgatcttcttgtgtagaatctttcaagggttctctgcatttcctgaatttgaatattggtctctctagcgagtttggggaagttttcatggatgatatgctgaaatatgttttccaagttgcttgctttctccccatctctttcagggatgtcagtgagtcatagatttggtctctttacatagtcttgtatttcttgtaaattttgtgttttcctttcaattcttttgtctttatttttgtttgactgtcttatttcagggagccagtcttcaagctctgagattctttcctcaccttgttctattctgctgttaatatttgtgatttgattgcattatgaaattcttgtagtgtgtttctcagctcttatcaggtcagtttggttcttttttatactgactgttttgtctataagcacctgtatatcctttcttgtgatgcttagcttccttggattgggtttcagtgttatcctaaatcttgatgttcttcattcctattcatattctgaattctatttctgttttttcagctctctcatatcagttaagaacccttgctggagaactagtgtgtgcagtcatttggaggaaagaagacactttggccttttcagttaccagagttcttgcactgttttttttttctcatctgtgtgtgtgggtgttcctttaactgtggtgtaaattgagtacagtcagtagacttcttttctggatgttttcagagggctgtggctttatgcaaggactttatttgtaactgaattcttgtctttggtttcgcaggggagtatgttcgcaaagtatttttggtgttgaagttttgcggtatgatctagtatgtggcacttatgcataatggtcagtaggtaggctcttgcgtagtcatgtggctcctgtgtatttctctatggttgcagctgtgtccctctcaatgctctgaaaatattggctcctctcccacttgagtgctggctgcagatctcaacttggcactcccaagctgtacactgtggctctggggtgatctcaggctttctgttcgctccccagtttggagacagcagaaggagggaccttagctgtggttgtggcctagggtctttcacttgtctcccgggcgctaccccagagacatgtagagctgtgatcaatcaatgtgattggcctgggatggggaggctgtacttacgtgggatcaacctggaggggccctacctggtgatgagcaagaggggtgggtgggacctgtgggagacagactggtctctccttaaagcaactgcagtttgctggaggtggggataaagcactcagggtctttactccttccccagtttgaggacagtaagagcagttccactgcagaggcagtggcagaggggctttcagttgcccctaagagttctacctccaagaaacacagagctgctgctactgggagtgttcagccaggggctagatcagctgcactgctgtcctgaggtaggggctctacttgttggggagcagggtatcatgggctcacagggaggagagaccggctcctctccgtgtggcgactttgttgtgctgtaagcttgcgtgaagccctcgagctctttgtttctttccccaactgagggtagcaggggcagaaactgctactgtggcagtggcagaggggctgttggttgcctccaggaacctcttccaaagaaaactcagagccactaccagtggggtatgctcagcagtgagtagggcagctgttctggagttgtgagcctggggccctgcctggtgaagagagggggatgaagacgcctaaggaagaggaactggactcccttccatatggtggctgcagtgtgctggaagtgccaatacaacaactaggccctttgttccttccccggcctaagggtagttagggcagtaccactgcagctgcagtggtggaagggttttgaattgactctgggatttcctacttggagaaatgctgagccacctctaattgaagtgctcaggtgggtgcagggtagttctgctggagtcccaggttgggaggccttgcccagtgagaagtggggacagatacctgcatggggaacaatgtggccacttttccatggagtagctgcactgtgctgagggtctgcaccagtgcctagttaccatggactcgtgagagcttgaaggtagcaaaggcaaggactgcaagagagcaaagatgttggcttgctccttctttgagctctgtcccagagatctgcagagctgccaccagcatgagaaccccagcgagggggtggctggagtcccaggttgggaggtcctgcccagtgggaagaaacgggattggagacccacatagaaaacagtctggctgctttttttagggtggccacactgtgctgggagtctgtgccacacggtagttgcctgggactctccagaacctgaagactgcaagattacaaagatggcagcccacctgtctgggaggtgaggagttgttacaggcctaagagccctagtagggggtaactaaagtccagaccagtgtgtctcagcctgtgaggcttgcagaccttcattgttcagcgccctggattcagcacctttcttggggttgtataagtgaggcttacctccccgcaacctttttttttgagacagagtctagctctgtcccccaggctggagtgtgcagtggcacaatctcggctcactgcaagctccacctcctgagttcacgccattctcctgcctcagcctcctgagtagctgggactacaggtgcccaccaccatgcccatctaattttttgtatttttagtagagacagggtttcaccgtgttagccaggatggtcttgatctcctgacctcgtgatccgcccaccttggcctcccaaagtgctgggattacaggcgtgagccaccgcacccggcctacctccccttttaccagagctgcagctgctaatgccaggatgcctggggatccagggctccttgggactctgcatatatgtgagtgtggctctgtccagtctccacatagctctgtgtatcagtccgaaggccctggtggagtgggctcacagggggatctcctgatcctagagttccaaagatcctaagtgtggattcctgaagtttctcactcactcaccatttcccatggagagggaacctcccagatggacagagatcctgtcttactcctctctgttcttcgtgggtcgagttgtttccttgatgaattccaatatgttcacctgcatgtttcagttgaagatgtagtgtttaattgctactgtttcttctctttgtgagtgtggcatactctagctacttctagtcagccatcttgtccttccccctcattcttcatagggttttcaaacctctctgtttatattactcattttttcttaaatgttgtccatttttttcccactagagcccttatcatactagtctgatagttccaaaaatatctgccatatctgagtcaggttctgatgcttactttgactcttgagactgtattttgcaatttaacatggcttccaattttttgttcaaagctagacatgatatattaggcaacagaactcagtaaaataggccttaagtgtgaggctttatgtttatctgtctaagaatcaggctatattcaatatttgttgtagctatagatgtcaaactctaaaatttcttctgctatccctgctttttcctattctgttgtctttgggttccccggagattactttttatataaggtctgatacttaacagttgttccagctgtaattccctgttattagacattagcctgattgatgtagtggtaagcagtgggtacaaggggtatatattctattgtcttatgattaggtcttagtcttttagtgacctagtacccctgtgctatgaccttcacaagtttttctcagttttttcttcccactaggtgatacgggaatcctagatggggctgaattggttattttccttaccctgtatcaggctaatgggtactagatctgggtatttcccttctttacagtcggataggcattgataaaacccaattcagttgggttctggtaaaatagtttccctttagggaagcagggatttttaaggagaacagaatactctgggcatatttcaaatggttactcccccctccacacccctgcccccaccgccaacccctgtcttcctactagaaacatgaggggattttatttatttttatttttatttttattattttttttaccagtctttatattgagaacctgtcagggctcctggaggcaaaactcacaaagatttgggagcctctctgagaggaacctccagatattttaactgtaaagctagtccacattgagccttccactactgggtctagcagtgggcgtctgctcctgagattctgatgtcagtaagctgtggttttcagtaaccacattttttctcaattttgggggcagtggcttgtcctgtgacctcaattctctgatggatctaagaagagctgttaattttcagtttgttcagcttttttcttatactaacaatgagagtaatgacttccaatcactttacatttcagactggaaatcagaagtctctgttgtattgattttttgagttctcatttatgtgactgaacatttcttgttagaagtaatcttacttataagttccttaaccatagtgccatgtaggagccataatgtcatccttagaaaaaacaagtttgagaacagctttctttctttgtattccttatcaatgaaaggtataacagaagcactgcccaatataattttagctcttatatttatgcctttcatatattcggagttaatttttatatatggcatgaggtaggagtccaagttcattctttgacatgtagctttctagttgttccagccatattttttgaagatattctttcacattttatggtcttggcaccattgttgaacttcagttgtctatagatgtgtttatttctggccattcaattccattccattaatctacatatctgtccttatgtctgtacctccctgttttgattattgtagctttgtagtatgttttaaaattgggaattgtgagttctccaactttttttttttcaagattgttttggctatttgaagccccttgcaattctatatgaattttaatatctgcttttccatttctgcaaaaaggggctttgtaattttgatagtgatgacacttgtccttgaagctttaagcaagaactatatagcctctgttcagtttgattgtgaggcttttttaaatttagcaggttacattgtgaatgatgtaatttcataggcaaagtccatttttgccatgtaaggtaacatattcgcagattccagggattagaaaattgacatgttgtgggggctgatacattatttagtctactgtactacttacagtaaaggcagtggtcatagaatcaagcaagttatatatgggtaaataaatgtggtaaaataggctatccatattttgcagaagctgaaattccagtgataaacacaaggtagagacttttaaaattttactactttcatagactctgtgtatcagcggtttgcaaccaccatatgtgttagttggaaataattcatcattattaatccttgtggggagaaattctgttaattagatgtttgggaaatgctattatagtttgctgtacaaagaatactagcagttatctcttacaaaacattgataataatatatttattttcccatacctacttaaaaattacaaatagcattttcctagaataaagggtctaggaaggacacaggaaaagagggggctattgctacttttcaaaagactcagtagacattagggaacatatttaagcagtcagtatatttgtagaaagcttgttgagttttttttctatccattttgtttctgtatgccagttttatcacaaaataatacttatgagttcacctttcctttctgagcaataaacaagcttaaggtatctaagccttgaaaattggccttggtactattctctaaatttgaagtaatgtctttgttcttcaacaaggtcttaccagctattgtcttatagccttaggatttggggcacacagcagcaagtttagggctgagtgagtacggactgactttgtgatatgctcagtatcaatatacccagcaatttcccaagtaattccctaaagaacagttctagtataccttcctactcctaaaaatcagactgcttttcctattttcctgttgttgtaacaaattaccataaatttgattgcttaaaacaacatatatttattatgttactattctagatgccagaagttcaaatttagtcttgctgggtttaagtgaaggtgttagcagggctggctccttctggaggctgtgagaggagaatccgttttcttgcctttttttcagcttctgcctgtgttccttggcttataatctctttctcacatcatttcagcctttaattttattgtcccacctctttctgtctttgaccttcttgcctccctcttttaatgactctgcttatgttgggactaactgcataatcaaggatagccttcccatctcaagatccttaacttaattatatgagcagagtccctttttgccatgtaaggtaacatattgacagtttccagggattagaaaatggaatattgtggagagggatacattacttagtctattatacaacttacagtgaaggcagtggtcacagaatcaagcaagttatagataggtaaataaatgtggtaaaataggctattcattgagttttgggcattatgtagatatctttaacattcttacttccagttattggcattttaccatctatgaattcacatgggtatatcataataaggggaaaattgatgagtgtcaaacactccagatttccttaccaaaagggagttgtgaaatttcacagttctgtaaattttacctcacaagtgaattaaaaaacaacttggtaacctgtcttgtggtagagttcctataaatatgataggagttcatttgaatactctctttaccatgttaatcttctgttatgggctgaatcctgtccaccccaaaattctcatgtttaagcactaatctcaagtacttccaaatgtgactatgtttggagacagggcctttgaaggggcaattaagttaattagggtgggtcctaattcaatctgattggtgtccttataagaactggaaatttggacacacagaaatactggaggtgcacatgcacagaggaaacaccatgtgacgacacagcaagatggtggtcatttgtaaaccagggaagggaggcctcaggacaaattaaacctgccaaaatcttgatcttggatttccagtctctaaaattatgggaaaaaaaatttatgttgtttaagtcacccagcccgtggtattttgttgtggcagcactaacaaactaaaacatcctcaaacatttatgtatttgtttggcattttacatcagattggaaaaaaaggaagccttgtgtttatggtaaaagtatagagtttcatagaagtttagactttcaaacttgataaatcctatcaaagctagagcacttttccagtattatgttcaattccagtgtagcagtgtgtacattagcttactacctgctttagatggcaaaatagaaaattaaatatagagagtacccagaaataaactcacacatttatacttcattgatttttgacaaaggttccaagaatacacaatgagggaagaacaatctctttaataaatagtgttggaaaaactggatatccacatgtagaagaatgaaattagacccttatcttacaacatatataaaaatcaactcaaaatgaattgaggacttaaacattagacctgaaactgtaaaactactagaacaaaaaataagaggaaaactccatgacataggtctgggcatttattttttggttacgaacccaaaagcacagggaacaaaagcaaaaataaacaagtgggattacttcaaactaaaaagcttccgcacagctaaggaaacaacagagtgaagagacaatctacagaacaggagagaatatttgaaaaccatatatttgttaaggggttaatatcaaaaatacataaggagctcaactcaatagcaagaaaacaataaccttatttttaaaatggcaaaggacctcaatagacatttctcaaaagaagacatacaactggccaacagatatgtcaaaaaatgttctacatcactaatcatcggggaaatgcaagttaaaaccacagtgcagtatcactcaaacctgttagaatggctattattgaaaagatgatagataacaagtgtcgatgaggatgtggagaaaaaagcactcttgtacactctagaaatataaactagtacagccattatggaaaactgtatggagattcctaaaaaaaactaagtatagaactatcatgtgatccagcaattccacttcttggtatatgtacaaaacaactgaaatcagtatgtaatatatacaaatatatatatatgtatatatatatatgtatatatatatatataatactgatttcagttgttgatatatatatatatatataacatactgatttcagttgttgatatatatatatatatatatcaggcacagaaagacaaatactccatgatctcgcttatatatagaatctgaaaaagtcaaactcatagcagtagaaagtagaatggtggttaccagaggatgggagcgagaacaggaatggggatgtgttggtcaaagggtacaaagtttcacattgacaggaggagtaagtttttgacatttattgcacagtattgcaattatagttaataattatgaattgcatatttcaaaattgttaagagagtacatttcgaatcttctcaccaaaaaatggtatgtgaggtgatggctatgttaattagccaaatttattccatcatgcatacatatttcaaaacaatgtattgtatatgataagtgtatacaattttgtgaattaccaaaataaaaacaaacaaaaccaaaattaaatttgaaatgtacattcaaagtaaacctagaatgaactgaacttactacaaacaaaaatctccacctctctctttctccccccattcctattttaattgaattacagtcagtaatttagggaagagtgggcaggtagctctaaaaaagcaatttgaattaaaacttttaaaaacctactgggtgagacacttgccagccaaaaatattgtctctaacaaaataatttgtctaaatattttatgggggtgcttctttgtctgattggtcagtgatagatgcttatagaagcataatgtctcttcccagattttaaatatagtgtaaactgatatgatttatataatcaacagaaaaccatatgttcaaggggtctttatattttcaacaaattgaacaatctgttttgtcccaaacactgtttctaggttctaggaatacagcatagaataaaacaaaacatcatcctcatggagcttacatttagggatgagggaaacagataataagaaattaaatatataaatatgtaatattaagtggttgtgaatgataccgagaaaaataaaacagggtatgagggtgttggaaggagggatactattttagataggatagtcagagaagttcattctgagcaaatacctgaatgaagtgatggagcaagtcatgaggttatctaacagataaatattctaggctttgggaacaacaaatacagtggtccttaggtaggaatgtgtttggcttgctcaaaaaacagcaagaaggctagtgtggctgaaatggaggaagcaaggggagaatggtgagagatgattttaaaatggtagccaggggccagatcatgtaagatattacaggccatggaaagaagtttggattctaagtcttacagaaagccactagaaggttttggcaaggggagctggagagctgtgagatattatatatatatatacacacacatatatatatatatgtgtgtatatatatatgtgtatatatatatgtgtatatatatatgtgtgtgtatatatatgtgtatatatatatgtgtgtgtgtatatatgtgtgtgtgtatatatatatatatatatatatatgctgtctccatatatatatatggagagagagagagatagacagtcttgctctgtcacccaggctggagcacagtggcatggtcacggctaagtgcatgcaacctctgcctcccaggttcaggcaattcttgtgcctcagcctcccaagtaactgggactacaggcatgcaccaccacacacagctaatgtttgtatttttaatacagacggggtctcaccgtgtctcccaggttggtctcaaactcctggcctcaagtgatccacctgcctcagcttcccaaagtgctaggattacaggtgtgagccaccatgcctggccatgacttatatttttaaatagtaatcctggctactgtgtagagaatggactctagagaaacaagaattgaggcaagaaggataactagtacctataaaacaattgcagtggtccaggtaacagatgatattgatttggaataagatctcagctgtggaagtggtggtaagtgtccagctttgaaatatatttagtgggtagattcaatggatgttgtagatgaatcaaatatagagtaagagaaaaagaggaattgattctgatgctgagcagctcagtgaatacagatatcacttattgcatttcagatgccttttagacatccatgtcaagatggaaagtaagcagttggagatataagtttgggactttggagataggtccagactagaggtagaaatttgagaaacatgaaggtataggtggtatttaaagccaagaggttggatgagatgactaagagatgtagatagtgtgagtagtaagagaggaagtccaaagattgagctttggcaaggatgccctctctcaccactccaattcaacatagtattagaagtcctatccagggcaatgaggcaagagacagacataaagggcatccaaaataggaagagagaaagtcaaactatctctttttgcagacgacatgattctatatctagaaaaccccatagtcttggccccaaatttcctttagctaataaacaacttcagcaaagtttcaggatacaaaatcaatgtataaaaatcactagcattcctatacaccaacaacagccaaactgagagccaaatcaggaaggcagtctcatttagaattgccacaaaaagaacaaaatacgtaagaatacagctaaccagagaagtgaaagatctctacaatgagaacactgctcaaagaaatcagagatgacacaaacaaatggaaaaacattccatgctcatggataggaagaatcaatatcattaaaatggctattctgcccaaggcaatttacagattcagcgttattcctatgaaactaccaatggcatgttttgcagaactagaaaaaaactattttaaaattcatatggaaccaaaaaacagtccgaatagcaatggcaatcctaagcaagatgaataaagctggaggcatcacactacctgacttcaagctatacgggctacagtaaccaaaacagcatggtactggtacaagaacagacacatagaccaatggaacaaagtagggagcccagaagtaaggctgtacacctacgaccatctgatttttgacaaacctgacaaaaacaagcaatggggaaaagactccctagtcaataaatggtgctgggataactggctagccacatgcagaaaattgaagctggacccttacttacatcatatacaaaaaatcaactcaagatggattgaagacttaaatgtaaaacccaaaactataaaaactctggaagacaacctaggtaataccattctggacataggaacaggcaaagatttcatgatgaagatgtcaaaagcaattgcagcaaaagcaaaaattgacaagtgggatttaattaagagcttccgcacagagaaagaaactgtcaacagagtaaacagacaaactacagaatgggagaaaatatttgcaaagtcttcatctgacaaaggtctagtatctagtatctataaggaacttaaatttacaagaggaaaacaaccctattcaaaagggggcaaaaggcttgaacagacagttttcaaaagaagacatacatgcggccaacaagcatgtgaaaaaaggattaatatcactgattattagagaaatgcaaatcaaaaccacagtgagataacgtgtcacgcaagtcagaatggctcttattaaaaagtcaaaaaataacagatgctggcaagattgtggaagaaaaggaacacttatacactgtttgtggaaccattgtggaaagcagtatggcaattcctcacaaaaaagcagaaccaccatttgactcaggaatcccatcactgggtatatacccagaggaatataaatcattctactgtaaagtcacatggacgcgaatgttcattgcagcactattcacagtggcaaagacatggaatcaacctaaatgcccatcagtgatagaccggataaagaaaatgtggtacatatacacactggaaaactatgcagctactaaaagaattagatcatgtcttttgcaggaacatggatggagctggaggctatcatccttagcatactaatacaagaacagaaaaccaaatactgcatgttctcacttataaatgggagctaaatgataagaacttatgaacacaaagaaggaaacaacagacactggggtctacttgagagttgagggtgggaggagggagaggagcagaaaaagtaattaataggtactgggcttaatacctgggtgatgaaataatctgtacaacaaactcccatgacgtgagtttacctatgtaacataacaaatcttcacatgtgccccggaacctaaaaggtaaaaaaaagattaggctttgcggcatttcaaagttgagatacaggagatgataataaatcatcaaaaacaaaagttaataaggtacagtcaaggagtagccaataaggtaggagaaaaaccaggaacatataatatgttagaagccaagtcaagaagatgcttcacagaggagggagtgatcaaccctgtctaacactactgttaggtaaatgaccaaatatcatttagtttcccaggacagtcctggtttatgcctgttgtacaggaataattgttaataagacccttttttacttttagaagtgccttgatttggatgataaattatatgctccctatgatgataggtcaacaagaggattgagaattgagtattggatttggcaacatggagatcattggaaatcttgaggaaagcagtttcagtggagcattcaacttcattggattgtaggataaaatgaatccaatgaaaaccaacttcattggattgtagaataaaagactggagtggtttgaagggaaaaagaggagacagtgtcataaacattgacaactattttgaggggttctacagcaaaacatcagagaattggggcattagctctggaatgatataggtacagggagaattttgtttttcaagatagataatagtacagcatgttttcatgctgatgagaatattccaggagagaggaaaatttgtgtagactatttttttaaagagcagtttaaggttcacaaaaaaagtgagaggaaggaacaaagctatcccatatattttctgcccccaaccatgcatagtctcacccattgccaatattccccacaacagtggttccatctgctaaaattgatgaacctacattgacacatcattatcacccaaactccactgttcacattagggtttgctcttggtgttctatgttctatgggtttggaaaaatatatactgtcatgtatctatcattgtattataatacagagtattttcaaaagcctaaaaatcctctgtgctcagcctattcattcctccctccccctaacccatggcaaccactgatccttctactctttccatagttttgcttttacatcatatagttggaataaaacagtatgtagtctttttagactggtttatttcacttattaatatgcatttacatttcttccatgtgttttcatggcttgattgctcatttcttttgagtgctgcataatattccattgtctggatgtaccacagtgtatttatccattcacctactgaaggacatctttgatgtttccatgtttgacaattatgaataaagctgctagacacatcaacgtgcaggttttggtttggatgtgttttcagtttatctgggtaaataccaaggagagcaattgctgaattgtatgctaagtacatttagttttgtaagaaactgctaaattgccctccaaattacctctacaattttgtattccaccagcaatgaatgacacttcctgttgcctcatatcctcaccagtatttggcactgtaagtgtttggattttggccatcctaatagttgtgtattggtatctcattgtttttataattagcatttacctgatgacatatgatgtggaatgtcttttcatatgttcatatgccatctgtatatcttcttaggtgaggatatatctgttaagatcgctggcctgtttttaaattgtcgtgtttgttttcttattgttgattttaagagctcttagtatattttggttaacaatactttcatcagatatgtcttttgtaagcattttctcccagtttgtggcctcagcctcttgacagcatgttttgcagatcagaaatgtttaattgtaatgaagtacagcttattaattctttttttaaaaaaaacacttgctttttatgttttttagtaatacgtagtatttttacgtattttggggtacatgtaatgttttgttacatgcatagaatgtgtaattatcaagttagggtatttagggtatccatcgcctctagtatttgtcatttctatgcgttggaaacatttcaagtcctcttttctagcttttttgacatatataatatatagttgttaactatagtcaccctataatgctattgaacattagaacttattccttctatctcactgtatgtttgtacccattaagtaacctctcttcatcacccctcatacacccaccttttttcatggattattgcgtttagtagtgtatctatgtcatcatcaaaccagggtcatccagattttatcttatgttatcttctaggagatatactttatatttaagactgtgatctatttttagttaatttttgaaaggtataaggtatgtatctagattaatttttttgcatgtggatgtccagttattccagcataatttattggaaagactgtcctttctccattatattgcctttgctcctttgtcaaagatcagttgaccatatttatatggatctatttctgggctctctgttctgttgcattgctctctatctgttgtccttcctttcactgctaccatactgtctttgattcctatagctttacagttagtcttgaagtcacaaaagcatgggatcccccattagtggatcgtcctggaatttttaactctcagatttgtacacacctagccttcagcaatttgtgaattacagttcagattttcctaccctagcactggttcccaaagaggtttctgttaaagtatgttgtgattctctccatctacgactttctcttcctatttttgggacagaggtttgtcttgtgacctcacttctcttacagatctaagaataatggttgatttttcagtttgttcaactttttacttgttaggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtattacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcctaatgctatccctccccttgccccgcacccccgagcagaccccagtgtgtgatgttcccctccctgtgtccatgtgttcccattgttcaactcccacttgagtgagaacatgcagtgtttggttttctgttcctgtgttagtttgctgagaatgatggtttccagcttcatccatgtccctgaaaaggacatgaactcatcattttttatggctgcatagtattccatggtgtatatgtgccacatgttcttcatttccagtctatcactgatgggcatttgggttggttccaagtctttgctattgtgaacagtgccacaataaacatatgtgtgcatgtgtctttatagtagaattatttataatcctttgggtatatacccagtaatgggattgctgggtcaaatggtatttctagtatttctagttctagatccttgaggaatcgccacactatcttccacgatggttgaactaatttacactcccaccagcagtgtaaaagcgttcctatttctccacatcctttccagcatctgttgtttcctgactttttaatgattgccattctaactggcatgagatagtatctcattgtggttttgatttgcatttctctaatgaccggtgatgatgagctttttttaaatatgttttcatatgtttgttggctgcataactgtcttcttttgagaagtgtctgttcatatcctttgcctttttgatggggttgtttttttcttgtaaatttgtttaagttctttgtagattctcgatattagccctttttcagatggatagattgcaaaaattttctcccattctttaggctgcctgttcactctgatgatagtttattttgctgtgcagaagctctttagtttaattaaatcccatttgtcaattttggcttttgttgccattgcttttggtgttttagtcatgggtaaaattttttgatgaagtccatttaatctattttttttcttttcttaatcttgcttttggtattatatccaagaaaccattgccaaatctaaggtcatgaaggtttacccctatgtatttctattagtccgctctcacactgctatgaagaaacaccgaagactggttaattcataaaggaaagaagtttaattgacttacagtttcacattgctggggaggcctcaggaaacttacaatcatggcggaaggcaaaggagaagcaggcaccttcttcacagggtggcagtatggagttagtgcaagcagggtaaatgccagacacttacaaaaccaccagatcttgtgaggctcactcattatcacgagaacagcatgggggaagctgctctcatgatctaattacttccacctggtcctgcccttgacgcatgaggattataggggttatgcaggttacaattcacgatgagattttggatggggacacagccaaaccatatctctattctaagagcgtgatacttttagctcttatatttatgtctttaatctatttggaattaaatattacatatggtatgaagaggagtctagcttattttttatttcagcaaaatattcattatattacataatcatgtaagttatatgcagtgaaatctcccttccatggtatgatacttcaatagattaaccaagtccccaaaataggtaggaagaaaaatattgtatccactggaactgcaagatgaacagtatgtagcctttttacaaggctttttttacttagtaatatgcatttaagtttcatccagatcttttcatggcttgatagctcatttatttttagtggtggatagtattccattttctggatatgccgcagtttatgttaatctagtagaggacatcttggttacttccaattattggcaattataaatgaagctgctagaaacatccatgtgcaagtttttgtgtggacatacgttttcaactcacttgcatgaataccaaggagttccacttcggtattatttgctaagagtatatttagttttctaagaaaccatgaccatcttccaaagtggctataccatgttgcattcctaccagcactaaataagtttctgttgctctacctcctttgcagcacttggtggtgtcagtgtcctacatgttgaccattgtattaagtgtataatggtatctcactgttgttttaatttgcattctcctgatgacatacaatgtggagcatcttttcatatgtttatttgccatctgtatatcttcttaggtgaggtgtctgttaaggtccttagcccattttttaatcctgtttgttttcgtattgttgggttttaagagttcttcatatattatagataacagttctttatcacatatgtcttttgcaaatattttctcctggtttgtggcttatcttctcagataacagtgcctttctcagagtagaagtttttacttttaatgaagtcccgctaaccaataccttattttgtgaatcatacctttggtattatatttagagaattgtcaccctacacaaggtaatctagacttttagaaaatgtaaccatctaggagctgtagttttgcattttacttttagttctgttagccattttgagttaattttgtgacatgtgtagagtctgtgtctagattttttttgcatgtgggtgttgagttgtttcagtataatttattgaaaagactctcttttctctgttgtattgcctttgctcctttgttaaagatcagttggccatatttacatgggtctgtttctgggctctctgttctgttgcatttattcgcctgtcctttcattgataccacactgttttgattactatagctttatagtaatttttaaagttgggtagtgttggtccaactttgttcttctccaatagtgtgtcagctactatgggccttttgcctctccatataaactttagaatcagtttgtcagtacttacaaaacaacttgctgcaattttggttgggatcgcactgaatttatagattaaatttggaagaattaatatcttgacaatattgaatcctcctatccatgtacatggaatatctctgcatttatttagttattttatttccttcatcagtgtttcatagtttcactcatatagatattgtgcatattctgctagatttatacctaagtgtttcatttttaggtgctaatgtaaatgttatcatttttaaactacaaattctactttctcattgctcgtatttaggaaagtcatttttaaaatatattaatcttgtatcctgcaacgttgccataattacttatcagttccagaagtttttttgttgttgtcagttctttcagattttgtacatacacagtcatttcatctgcacatgaaaacagttttctttcttcccagtcagtataactttaatttcttttttcttgtctttattgcattagctaggacttccattatgatgtagaaaagcagtggtgaaagggaaaatatctgcctcattcctgatcttactgataaatcaagtttctcaccattaagtatgatgttagctgtaggtttttggtaaatatcctttatcaagttgaggaagttctcctctatttttagtttgctgagacaactttattcttttatctgtggatatctggttctctcattaccaccaccacatatagagaacggacaagatttttaataaatggtgattgcgtcctctattagtttgttttcatgctgctgataaagatgtacccgaaactgggaacaaaaagaggtttaattggacttacagttccacatggctcaggaggcctcagaattatggcaggaggtaaaaggcacttcttacacagcgggagcaagagaaaaatgaggaagaaacaaaatcagaaacccctgataagcccataagattttgtgagtcttattcactatcacaagaataacacgggagagaccaatccctgattcaattacctccctctgggtccttaccataacacgtgggaattctgggagatacaattcgagttgagattttggtggggacatggccaaaccatatcatttcacccctggcccctccaaatctcatttcctcacattttaaaaccaattatgtcttcccagcaatcccccaaagtcttaactcatttcagcatcaacccaaaagtccacagtccaaagtctcatatgagacaaggcaagtcccttctgcctatgagcttgtaaaatcaaaatcaatctagttacttcctggataaaacgggggtgtaggtattgggtaaatacaaccattccaaatgggagaaattggccaaaacaaaggggttacagggcccatgcaagtctgaaatccagtggggcagtcaaattttaaagctccaaaatgatctccttcaactctaggtctcacatccaggtcatgcagatgcaaaaagtgggttcccacagtcttgggcagctctgccctgtggctttgcagggtacagcctccctcctggctgcttacatgggttggcattatctgtggcttttccacgcacacagtgcaagccgtcagtggatctatcattctggggtctggaggatggtggccctcttctcacagctccactaggtggtgcctcagtagggactctgtgtgagggttctgaccccacatttcccttctgcactgccctagcagaggttctccatgagggccccacccctgcagcaaacttttacctgggcatccaagcgtttcttacatcttctgaaatataggcagaggttcccaaacctcagttcttgacttctgtacacctgcatgctcaacaccacgtggaagctgccaaggcttgcggcttccaccctctgaagccacagcccaagctgtatgttggcccctttcagccacagctggagcagctgggacacagggcaccaagtgcccaggctgcacacagcatgggggccttgtgcccagcccacaagaacacttttcctcctgggcctccaggcctgtgatgggagggactactgggaagttctccgacatggcctggagacatttttcccatggtcttggggattaacattaggctgcttgctacttatgcaaatttctgcagctggcttgaatttcttcccataaaatgggtttttctttcttatcgcatagtcagcctgcaaattttccaaacttttatgctctgcttctcttataaaactgaatgcctttaacagcatccaagttacctcttgaatgctttgctgcttagaaatttcttctgccagataccttaaatcatctctctgaagttcaaagttctacaaatctctagggcaggggcaaaatgctgccagtctctttgccaaaacataacaagcgtcacctttgctccagttcccaacaagtccctcatctccatctgagaccacctcagcctgaattttattttccatatcactatcaacattttgggcaaagccattcaacaagtgtctaggaagttccaaactttcccacattttcctgtcttcttctgagccctgttccaacctctgcctgttacccagtttcaaagtcgcttccatattttggggtgtcttttgagcaacaccccactctaccggtaccaatttactgtattagtttgttttcacgctgctgataaagacatacccgagactgggaagaaaaagaggtttaattggacttacagttccacatggctggggaggcctcagaatcatggcaggaggtaaaaggcacttcttacatggcagtgacaatataaaaatgaggaagaagcaaaaatagaaccccctgataaacccatcagattttgtgagacttattcactatcatgagaatagcactggaaagactggcccccatgattcaattacctccccctgggtccctctcacaacatgtgggaattctgggagttacaattcgagttgagacttgggtggggacacagtcaaaccatatcaagtcccatcaatggaatgtgagtggaaatgatgtgagcatttcctcaccatggattttaagaaggaaatcaactacttctattctcctttttctcatttgctggctggatgcaggctgtggtgaggccctatcatgatgaggcaggaagtgatggttagttaatgagaaacaacaacaaaaggtagtgtagttttctcattattttttctattatagaaagcaatttgacattccattaatttctaatatttattgacattgtggaaattcaggttttcttctccctgtaaagctaattagctctccttgccagctcctatagttctaaaaatcctcaaggggtatttcctatgtcctgaatttttggggttttcctgtgattcttccagttgttgctgccattctaagctgtattgccaggcatttaatgtcctctaattaactgttctctctaatttcctaactccacctatacacagggttttcatgatgtcagatctgagtagtagtcaaaagtttaaatccatgttagaaaggaggatattttcctctctttaggttatgctttattaatgggttccttacactggagcattacagagtttacttaaagacagttatttcctggatatgtataaacctgcctttgctatgacagatatacagttgagggtttgtgttggaataggcacaaataggagttctataataatttcagtgttgctattagaatatctatacttccctaatggcaaggcattgttcatgggctagggtccttgtgcgtgacttggtttttcttcaagattaattctcttgaagtagaccccaccccaaatatgacctgaaaatattcttgggccaggcctccccaccagttctgcaaatgtaccctgtctcaagaagtagagacaggctgagatctttcccatagcattttcaggctacactgaaaatagacatctgttgggccaatttcaccatatagttcaccagaccaacctcagcctagttattcctgactacaggggactttaatttctgtgtacaacctttgaaactttgagatagaagaaggggatacattataagaaaacacagggtttggctcagcctcgaccaaaagagaagtctcagaaggaagctttgcttgaggcccataaaggacagtatagaggcaagtaaaactaaataggcaaaaacaagtccatgaccatggtgattgagacagacaagaggagaacaggcaagtgataggctggtgtgcaagttcatgagcatgcttgggggtggtgggtgggatttggaagaaaacagtgagtatgatgagtgagcacagttgcatctgtatcatggacttaatgcttatggattatttggctctgacatttagatttcagtggtaagtcagggttacacaggtgctagtgtaggcactgaggagtagaaagatgactgttgcaatttattgaactagaatcaattataggaggaaataaatagtgcttagcagtcagagtatcttatttcaatcttttatttgctcaaaggttttaaaaataataatctatttgatacatacccatacaaagctaacatatgaaaagcttaaagtagggcctttatcacttcaatacatactaaccaatacaagaccatgttttctaagagtactgacaacaaattgtccaacacacattttaaagtctcacacagtaaaatttgtcagcttttggtagaaccattcctctgtcagtaaatatcttggaataaagatcctagcacctgcagaattaccacagaagcttgtgcaaatgtgattttggacataattataaaacagtaaaggggattggtggctgtattggtgagatgagccctaaaatatttctcagagactgaagcacaggtaaagaaaggcaatgggaatagaattcatcaggatggtgagtgtattctgttcctactcctgctattgttaccaaccaacacagtgggtgggttcagtcgtttgacatcaaccccatgatcacagcaaggatttagtaaggggatttattacttgtaacgaagtaatgagaccaccagggatacttcccaaaataatgtctccctgagatgggggctgggtcaggttttcataagcattgggtattaagggtatatcctgatggctttggatcttacaatgaggtgatgctgagaggcatgatctgactggatcctgccatccagtgtccacttcttaattcagccctggtcctaattcaaaacacttacattctccctctgattgcatgcttggttcatctgaggatgctcaggtaacatgatctgagggtccccggcaactgaaagacaatgcacaactttgttatataaaagttaaaccagataggtctggtgctgctaccctgtaaccagttaccatacatggaatggcttaaaataataccaatttattattatcttacagtcctggaaggttggaaatcttcaaagggcttcaccacactaaaatcaagatgttgccagaggagctatccctctggcatttctagggaagaatctgtttctttgtcttttccaggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaatgatcctttgtcaggtaatataaaatggtacatgttctggagaacaggacatggacatctttaggggaccgttacctgccaaacacaatgagggtagtgtctaaatgagttttcaaatggacaacagtaacaacatcaacttggtgtttaaccacattgctctgtctgtcccatgcaggaagcagggaaaggaggggctcaagagtagaggacggatgtgggggtgaaagaagaggattcaaatgagccaggttgctttgtctcggggaggggggtgcacggtgggatcctctcctgagaatgactgctgaaacaataggtagttgtggcaggtggcggagatccaagctggtttgataccagccacatttccacactgccaaatatcatggcaagagaagacttgacagggaaccgaagagaagccaggaccatccctacctggcggcatcaaagagagaggactgttatgacctcctgcgggtcctgacagggaaaggtcctcttttgggggcaactgtggggacggtgcaatgccaacgtgagccaccatttgaaatgagaaacagcggtgtggcagaaagaaatgagtctggtgcagaccagtggttggtttcctagggttagaggtctaggtctaccttcttttagaagaggggcagtggtgagtccttgatgggagccccctgccccggagttcacttaagagcaggtgtaccttcctcccctgcgtggctccacgaagctgggaaagaaacgcacaggacgaccaccctagaaccccgggcctgtctggactgaaatcgcctctcccctcccacactgcagtgctgacaccccctctcccattaacatccaggaaggagggtgagcagactagggagggggagagggcaaacacccagcagtccttataggggggcggttggggcgggggtgcagacacaccaagggacggtttggtatccatccgctgctccctccagcgcggctcttcgcgacctcgcgatcctgtcctccgcccggccccgcagccgcccgccggtgccatatattatagcagcgccagaaatgtggtggtcgtcgccacgttagggtccgcggggtcctcctgaggcagcctggtgccaacccgcaggccccggctggggctcgtcctggccccgcccacctctgggtcggaactatggtggttctgtgagggggggcgtcctgcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcaagtaggggtgcgtgaggtggggggccgtggtgtgggggtggtccgccagggtggaccggctggcaacctgccccccggaccctgacagcctggcaacgaggagacgatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccgcgcgcagccctcgacggtttcggtaccgagagacggctgtgggggaggctcctgcgggagaaatggccaaacgggagccgtgttggggggcgcccgggaggcagttggggggcgcctgggggggccctcgtgggccagcgtcccagctctgtgcctagcccgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttag

SEQ ID NO: 893 - DNA, 57851 bp, mus musculus
cgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtgaacactggatacgcgacctggtcatgggaggcgggcggtgagaaggagagagagatgggtaattggaatggcacacaacaattaaaaaaaaatgatctaccttttgctagcttgatttccatacactcggttcacctcagaccatgcttgggaagaaaaaggttgcagcttctagcagggaaaaggcagactagatgaggaagagagggctacttccacaggcgaggacagttgtctggggagccctgagagggagagaatgtaaaaagaggttgtaaatgtttgataatcaaggctctggatttgaaaagggtctcatgtcttggttactggtctgaccattaataaccacgtctctctctctgtcttttcatttgttctttgggtgtgtatcacgcgtttttatgtgtaaatctgttcctaagtttgcagcactccatgtttctgtaaagatctgtaggggacagcagacctcaaggggagaggagaaggaaaagaaaattggcctggtttgtacagagtgggcagtacttgggaggcagtacttggaggtggtagatggctaagattagagtaggcaggagtgtaagggagcctccagaactctctgccagctttcctaacatgtcctcccttacccgcattatgttgcagaaaatgataggctttgggagagaggaaggaaacataggaacccagatgaaatatggaaataaatacttttcattttttccccagcctccgtggtttgtctaggcatttcgtccctactaacaccactactactaccttgtagggatgtttgagttgtctctgtataggaattgtcagactttgagaatagagcagaggggcttggagatttaggagtgggagaaaaaggggagatagaaaatgtttgccaaacaggtacttatatccagaaagaaactgtgccctaggtgctggtctctaccaaaaacagcctcaactgtctcctgtgtcttcatttattggtctctgtttttgtgaatccctgtaggtagatctgtccccaggtctgtggaactgtcagttgtgaagttttgtaaaatggtcacccaacttaaaactaggaaattacgaagaagagaaaattgccctgtatctgttaaggttggtgtaaaggtacagggacaggggggcaacttcgactagagaattccatctcttctgttttgtcattttaccaattattcccatctgccccaccccctgctgctgctgatttagttgggagtcttggtaagttgtgggggtacagaatgctaagctgcctttcccactctccactgcttgtcctgctctcacgcttgaacctagtctaatctgaacgagggacattctagggcaatcactgaagaggaagatggtgggcaataggaaggaggaggaggagtagccctgaaacaaagcagtgggggagaggggataggaggagggaaacactagacaaaatctggaaaggcaagaataagggcaagggaccaaggtctgtcaccaggagatcagtttccacattctcctgtttgtttatttgtccataggtctgcctgtagatctgctgtagggcttgtcaccattggaagcaaggtaaggaggagaaagttactccagatcagtgcaggttggtatgagtgtggggattgcctgggtagacctgtaggatggagtagtggagagctgcttggctccagcaggggtcaagaaccactaaagggattcctcagcttctcatccagttttcctactccttatgctcctgtttggtgactggaaagaaggctgatggcacttggaagtgtagggagtgggtgaaatgaagggagagagagtttgctaattatctacctctctcacctagcactgaatcaccatattctcctgtctccctgtgctgatcagcatgaggagaaaaaagttggaagagactcaaagccccatttccttcctccacccctaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaatattgtcctagttcttcagctgaaatctagtctggggggataaagcacagagagcataaagatggtgaagaacactgcctgtgtgtctgtagtggggcacaaacaaaacaagttcacattgacagattatttagtttcgacatacttaaaaagtagaatcactctatgcaagaaggcaggactgtgctattagttgtctgtaggctcctactgatagggcttcaaatgaggaatgaagccctatctgggcagctctggggaagggagtaaggaggaagggaatacagatgctttcattgtagtctcagttccggaacttgtgctcagcttttcacataaaatgtctcatcaggatgccttgaagctttttaaccccaagaggattcctggttctcacccctattcagtaagccatggacagctgcacaggaagtgtggttctgaagggacccagccccactgtgccttcaacagctccctccctatccaggggtatcagatttactgcttcatctgtgattctctcccccagaagtcctgggcctcagaggagagtctttctggggattacctactgaaactgcttcatagataatctcgtctgtctcatctggtgactgtttactccttacctttgttttctggccaatgtttggacttggtgatttgtaccacagttggtagcagccccttgtttgtgctgattctttttggtcagagctcagctctatgtatggcatagccacaggataccaaattcctttagaagtgcgtagttaggaagaaattaattcccataaaacccactgttctgtctattcgcatagtttatagagctgaagccatgttgtctatactaagcttgtcctgtttattcttaacaaaagctaggttctctgcaaggatttgtggaatagaatgacaatgtatagtttaggattttggggtcacctctgcctctcctaccccctgcctcttttactgttaatttactgcccagaattgggaaatataaatattaggatcagtatacaaatggtctttctgttgaccttcctctcctaactttttatacatttaggggaaggtctaaagtggaaaatctcaatatggtgtaatggatccctacttttaatagctatctgtagtttaatttctactaggatcagttgtgaatctattgtggtacatctaaaagtttaaatgaagcacagttagctacacttgtgcattaagggaaacaagcaaggtagtttttttgcaatgtgaaacttcaatttagatgatttttgaagttctttataacattttttaatccacagaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggtgagtgtggggtgtgtacgtatttgtgtcaaagcacaaagttgatggtctctccttggatgggaattgtgggatgcgaagtcatctcctagattgttcatgaggtgtcatctgttgatggacacttaggttgtttccatcttttggctcttatgaatattgctgcagtgaacattggagtacaagtatctgtttgagtccctgatttaaattcttttgggtatatacctagacgtggaattgctgggttgtatgatttgtttagctttttgaggaattaccagctgttttccacagtgcctgtaccattttacattcccgtcagcaatatgcaagggttccaatttatccacattcttggtgacacttgttattttccattattatttaaatagccatcttaggaggtgtgaagtagtatatcattgtggttttaatttgcatttcccgaaagtcttatgatgttgagcatcttttcatgtgcttattggccatttgagtatattttttagagaatgtatgtttacgttctttgctcatttttaattgtgtttttggttattgttgcattgtaggagttttaaaatatatatattctggatacatgccccttattagctatgtgatttgcaaatattttctcctgttctgtaggttttttcacttttgatgatgtcatttgatgtgcaaaagtttttaatttcaatgaagcccaatttatctatttttttcttttgttgctggtgcttttggtgtcatatctaagaattcatcaccaaattcaaggtcacaaagatacccatatgttttcttctaaaagttgtatagttttaaacatcagagtaattagtgtttctatcacctcaaacatttatcatttctttgttttgggaacattcgaaatcttttcttgctatttgaaaatatataattatttattgttaactgtagtcaccctacattgctatatagatcattagaacttattcctcctatcttgctgtaattttgtatctgttaaccaacctttcccaccccattcctttccctatattctcttaacttttaattgaaaaaaaaaaaccacaataacttttgcaccatcctaatagtaaccactattctacactctacttctatgagatgagcttttatagcttccacatgtgaatgataatatgtggtatttatctttctgtgcctggcttatttcatataatgtcctccaggttcatccatgtttccaccaatgacaggatttctttcattgttatggctgaatagtggtctgttgtgtatatataccacatttttttatccttgcatctgtttatgggtacttatattgattccatatcttggctgttgtgaatagtgctgtgataaacatgagagtgcagatatctctttgatatactgatatcctttctttttgatacatacccagcagtaagattgctggatcatatggtagttctatttttagtttattgagaaatctccatgctgtttttcataatggctgtactaatttacattcccacctacaatgtataagagttccattttctctgcatccgtaccaccatttgttatttttttttgtctttttgacaatagccattctaactggggtgtgatgatatctcactgtggttttgatttgcatttccctgatgattagtgatgttgagtgttttttcatataatttttggccacttgtatgtcttcttttgagaaatgcctattcagatcatttgccaatttttaaattgaattatttgtgtttttgttgtttagctgtttgagctccttgtgtagtcgtgttctacacaatgtttcagtcaatgatggactgcatgtatgacagtggtcccataagaatataataccaaatttttgctgtaccttttatatgattagatacatgaatacttaccactgtcttacaattgcctgcattattcaatacaataacattctatacaggtgtgtagcctaggagcagtaggctatactatgcagcctaggtatgtagtaggctataccatctaggtatttgtaagtagtacttttcttcttctaagtagaagagcttttttgcccttcttcttttagaagatcttaagaaaatctgaatctatgatagtcttacaatggtgaaaatgcctaaggacacatttctcagaatgtatccacatggttaagcaatacatgactatatattctggatattagtcccttgtcagatgaatagtttgcaagtattttctcccattctgtagattatctcttcactctctgattgtttcttttgctgtgcagaagctttttagtttgatatcccatttgtctatttttgctattttgcctgtgcttttgaggtcttatccataaaatcattgcccagaccaatgtatttctcctatgttttctttttctagtagtttcatagttacatttaggtctataatccattttgagttgtgctaggaaacctggatatccatatacagacgaatgaaactagacctctgtatctcatcaagtactgcagaattttgattacagtagttttgtagtacattttgaaatcaggaagtgtatgtgctccaactttgttcttctgcttcaagattgtttttgttattctaagtccctttccattccatgtcaattttagagtcagcttttccacttatacaaaaaagtctttggaattttcacattgaaattttgcttgggggtattgccctctttataatatttagtttccaatctataaagacataatgcccttccatttattttggtctttaacttcttttagcaatagtttatagttttaggtatgtaagttgttcacctccttagttaaatttattcctgggtatttcattcttttatatgctattgtaaatggaattattttctttctttttcatattgttcattgctggtatatagaaacataactgatatgtgttgattctgtcacttgcaactttgctgaatttattcactctagtagtttttttgtggattcttttgaaatttctatctatagggtcatgtcatccatgatagaaatacttttatcttcttttttcttatatggttaccatgtatttctttttccggtctaattgctctggctgtaacttgaataacagtgcagaaaacgggcatgcttgtcttgttgctgatcttcccagtgaaagctttcagtcttttactattgaatgtgacattagctgtgggattttcataaatgtcttttatcatggtaaggaagttcctttctgtgcctaactttatgagtgtttttttaaaggatatcaggttttatcaaatatcttttttgtatcaacagagatgatcatgtgcagatttttttgttctattcaactggtatattacatcgtttgactctcttatgctgaccacccttgcatttctaggataaatcccacttggtcatggtatataatctttttaatatgctgttggatttgttgtgctgggattttgttgataatttttgcatctatattcataaggaatattggtacgtaatgtttccttgtgatgtcttcatctggttttggtatcagagtaatgctggctccgtagaattagttagaagatattcccccttctactttttagaagagcttgagaaggattgttgttgactcttctttatgtttgttggaattgtctagtgaaaccgtctggtcctggaattctctttttggggaagtttttgattactggtctaatttcctcactctttatgggtcagttgagattttctattcagttcagtgtcttttctattcagatttggagtccgtttatataatttacatatgtttttaagaatttgttgatttcatctaagttatctaatttttggtgtataaatgttcattgtgtacttttaatcttttaaaatttctgtgtggctggtaataatgttccccctttctggttttagatatttgtgtcttctttttttgtctctagctaaaagattgtcaattttctttatctttttgaagaaccaacttttggtttcattggttctctctgctgtttttccgttctctattttgtttatttctactcgaatctttattatttccttccttcagttagctatgggtttcatttgctcttctttttctcgttcctcaaggtgtaaagttaggtaattgatttgagatctttcttattttttaatgtaggtgtttatagtataaacttctctctgaccactgcttttgctgcatcccataagtttagttatgctgtttttgtttttattcatttctgagtattttctgattttccttgtgatttcttctttgacccattggttatttaagagtgtgttgtttaatctccatatatatgtgaattttttatttttctttctggcgttgattcctagcttcatccattgtcaatgaagataatttcacatgatattagtcttacaaagttcattgagacttattttagaagaatgtgtttttgctattgtttggtgcagagttctatatatgtctgttaggtctagttgatgtataccactgttcaagtcctgtatctctttattgatctcgagtctagatgctctgttcattattaagtatggggtttgaagtttcctactattattataaaactgtattttttctcttcagttctgtcagtgtttgcttcttcttagggactttcgctttcctacttatttaattctcctgtattttaaccccactatttttataggtttccccatatctgcatggaacatataatcatttttcccttgggaggaaaaaaatccttttcctaacactaaactcacacttttccagctatctttctcttcaccctttcagaataatcaagttttccgcatttgttgtttctgctttctcatttcctactcagtcctcacacaattgcaatctagtttctttctccactactcaactaaactctgcctcagaacttggtgccctgtgtcctagctacttcaactccagctgtggctaaaaggggccaaggtacagctcaggctgttgcttcagaggatgcaagccccaagccttggtggcttccacatggtgttgggcctgtgggtgcacagaagtcaagaactgcagtttgggaacctctgcctagatttcagaagatgtatggaaatgcctggatgtctaagcaaaagtctgctggaggggtggaaccctcatggataacctctgctagggcagtgtggaagggaaatgtgggattggagcccacagagtccccactggggtactgccttatggagctgtgaggagagggccaccatcctccagaccccagaatggtagatccactgacaccttgcactgtgcacctggaaaagtcacagacactcaacaacaagcctgtgaaagcagctgggagtggggctgtactctgcaaagccacagggtcagaactgcccagggccgttggagcccacctcttgcatcagcataatccaggtgtgagacattaagtcaaaggagatcgttttggagctttaagatttaatgactgccctgctggatttcggacttggatggggcctgtagccccttcgttttggccaatttctcccctttggaacaggagcatttacccaatgcctatacctccattgtatctaggaagtaactaacttacttttgattttaacaactcattgacagaagggtcttgccttgtctcaaatgagactttggactgtggacttctgagttaatgcctaaatgagttaagactttgggggactgttgtgaagacatgattgtgttttgaagtgtgaaaagtcatgagatttaggaggggttgggatggaatgatatggtttggctctgtgtccccacccaaatctcatctcaaattgtaatccccacgtgttgagggagggacctgtaatccccacctgttgagggagggaagtgattggattatgggggcggttccccagtgctgttctcataatagtgagtgaattctcataagatctgatggttttataaatggtggtttttcctgcactctctctctcacctgctgccatgtgagatgtgcttgcttcccctaccaccatgattgtaagtttcctaaggcctcctcagccatgcagagctgtgggtcaattaaacctctttcctttataaattacccagtctcaggtagtatctttatagcagtgtgagaacggactaatgcagccatggagtataatttttcaaatatgctgctgaatttggtttgctagtatattcttgagaattttgcataagtattcataatagatattggtttatggttgttagttttttcttatagtacctttgactttggtaccaagctaataggaagtagcccctcttctttcattattttttaaagagcttgaaaaggattcctgttaattctcctttaaatgtttagtaaaatttactagtgaaacgatctggtccagtgtttttctttgttgggaggttttttgattactgatttgatatcctcactagttataggtgtattcagattttctattacttaattattcagttttgctaaattgtatgtttctaggaatgcatccatttcatctaggttatccagttttttggcatgctgttgttcatagtactcatactctttttttgtttctataaagtggtaataatatttctgctttcatttctgattttattaatttgagttctccgtcatttaaagtcaatctagctaaaggtttgtcattaaaaaatattttcaagtgctgacttttgatcttactgattttccttgttgttttctactccatatttatctccattctagtgtttattatcttctttctgctggctctaggcctagtttgttattctctttcggattccttaagatgtatagtttagttgttgatttgaatttttctttttctttctttttttttttttttttgagatggagtcttgctctgtcgcccaggctaaagtgcaatggcacgatctcggctcactacaacctccatctcctgggtttaagccattctcctgcctcagcctcctaagttgctgggactacaggcatgggcatgcgccaccacaccaggctaatttttgtatttttagtagagatggggtttcaccatgttggccaggctggtctcaaactcctgacctcaagtgatctgcctacctcggccccccaaagtgctgggattacaggcgtaagtcaccacgcccagcctgaaattttgttatcttttaagtctaatgcttattatctccttattgccttcaatttcactgaattctgctcttttatgatttctttgttctgctcaatttggatttaatatcctcttcttgttttagtttttaaaggtggcatgctagataattaatgttattgatacttcttttttctgatatatctattcaattctacaaatttactgttaagcactgctttatttgcatgccgtaaattttaatgttatattttcattttgatttattttaaactattttaaaaattttctcttggtagttcttctttgatttatttgttattcagaaatgtgttgtttaattttcaaatattttggatttgacagctacatttctattattttcttgtttaattccattatggtccaagaacatacactgactaatttgctcttttaagtttgttaaggtattttttgtggctcacaatatggtccatcttggtgtctgttccatgtgatctttagaagaatgtatattctggttttagatgaaatattctacagatgtcaattagaaccagttaattattggtgctattcagtacaactgtgtccttactgcttttctgcctagtggatctttcaattactgagagtgttgaaatctctaattatcatagtggatttgcctgctttttttttgcaatgctatcacattttgcctcccatattttgatactctgtctttaggaacatatatagtaagagctgttatgtcttctttgacatttgacccattcattattgttgaagtctgcttttttcttttgattcttttgattagtgcttgcatcttatgtcttagtctcctttactttcaagctatctgtgtctttatatatatatagtggattgttattgacaacatatagttgggtcttgatttttttcattcacccctaaagtctgtcttttaataggagtattcggacaattcgtatttaaagtgattattgacatatttggataaatgtttaacacatttgtaactattttatgtttgttgccatgttcttagtgttgtattttgtaatccactttgtttccgtcttctctggttttaattgagcatttaaaaaattattccatttattttgttctcttagtgcattaattatacaagctgagtatccctgttttgaaaatttgaactctaaaatgctccaaactctgaaactttttgagcaccaatgggactttaaaagaaaattctcattggattttggatctcaaattttttgtattagggatgctgaactgatataataagtataatgcagatattccaaaatctgaaaggaaaaaaaaagctggaatcttaaacttttctggccccaagcatttcggagaagtatttctttttacaattttcttagtgattgctctaggtttgtcatatacattagcaactactctaaattcagtttcacataacactatactgattcatgggtagttcacatacctcatgacaaggtgttaccaattcttctctctcatcctttctaacattgttatcattatttcaaatatcaataagctgtaatcactgaatacattgtttctattgttattttgaacaaattattgtctattagatcaattagaaataagaaaaatatggttgactgttgaacaacacaggtttgaactgcacaggtccacttatatgcagattttcttctgcctctgccaccccaagacagcaagaccagcccctcttcttcctcctccttggcctactcaatgcgtagatgataaggatgaagaacttcatgatggtccacctccacttagcgaatagtaaatatactttgtcttccttatgattttcttaatagcattttcttttctctagcttactttgttgtaagaatataatatataatacatctaagatacaaatatgtgttaataagctgtttatcagtaagatttctgatcaacagtaggctattaatagtttgggaagtcaaaaattatatatggatttttgactgtgcagtggggtcagcacccctaacccctgtgttgttcaagggtcaactgtaaaatatttgtaaatttcatttatcccttcttcaacaatctttttttcctatgtagatctgactttcttacctgtataattttccttctctctgaactacttttaacatttctggcaagagaggtctactggcaataaattctcttaattttttaaagcacttctaggagactgtcaggaaacaaatccagcaagcttattgttttatttatgaaaacaaatcctcatttgaatgtcccaaatcaaatggtctttaaatacaaagactcacaaccagagttaaaaatttttacatagaacttattgaagtagttaatcatggaagttaatcataattatgttttcagataaagtgggtggctcttaaaagtgactttgagttgggtagaattattgctgaggaagctttatgctttctgtctacgaatgtggcatgtaagctcgatgttcttgagcatgatagtcactcagagtggatggcgcacagattgatgttctcaaagagccccaccaggtaggcctctcacacttcctgcagctgctgagctttggaagtgcaggttggtcttgaagttctgtgcgatcttgtgcaccagatcatggaatggcagcttgcggatcagcagctcagttgatttctggtagcagcggatcttacgcagggccactgtgccaagctagtagctgctagggcttatttatgcttctggtgctggagcactcttgcgggctaccttggtggccagattttttttttgtttgttttataatttttatataacattttaatgttttataattttttatataacattttaatgtcttataaaaacaaaattatataacatttttctaggtgaacttattctttgtgttcctgggatgtctatagacaatgttacagtaacttttgactacagatcattttttttcaaatgatataatattgataaagtattgtagggctcccaaaataaaatgagttggttttgagcctatggatgagaaatctgctggggaaatggtcaaattttatgtatttttttttattatactttaagttttagggtacatgtgcacattgtgcaggttagttacatatgtatacatgtgccatgctggtgcgctgcacccactaactcgtcatctagcattaggtatatctcccaacgctatccctcccccctccccccaccccaccacagtccccagagtgtgatattctccttcctgtgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcagcacactacctgacttcaaactatactacaaggctacagtaaccaaaacagcatggtactggtaccaaaacagagatatagatcaatggaacagaacagggccctcagaaataacgccgcatacctacaactatctgatctttgacaaacctgagaaaaacaagcaatggggaaacgattccctatttaataaatggtgctgggaaaactggctagccatatgtagaaagctgaaactggatcccttccttacaccttatacaagaatcaattcaagatggattaaagatttaaacgttagacctaaaaccataaaaaccctagaagaaaacctaggcattaccattcaggacataggcatgggcaaggatttcatgtccaaaacaccaaaagcaatggcaacaaaagacaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactagccatcagagaaatgcaaatcaaaaccactatgagataccatctcacaccagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtctttgtagggacatggatgaaattggaaatcatcattctcagtaaactattgcaagaacaaaaaaccaaacactgcatattctcactcataggtgggaattgaacaatgagatcacatggtggccagatgttgacatggcagtttacctccagtagacttgtgtgtagtctgcttgatgtgggccatttcagattaaccaaagaaaaaacacagatttggtctcaaattatgtttgtctgaaagtctttatcttctacactttagaaggattattttgttgtatcagtatttcagattggtgtgtttttttactataacattttagatattccactccactctcttcctgatggcatggtttctgaagataagttcaacctaattcttagccttgctcttctgtaagtaaggcattttttttcttttggcttctatgaagattttatcttaatctatgaagattttgtctttcattttctgcagcttgagtataatatgtctatgtgtaaatttttttggttaaattctgcttagtgttctgtgagcttcttggatttgtggtttggcatctgctatggtttgaatgtcccctccaaaattcatgttgaaattttattgcaaaagtaatactgttgggagttgggacctttaagaggtatttagattgtgaggtcttcaccatcatgagtggattaatgccattatggagggcgtgggttagttattccaggagttaggccctctttttttctttgtctcacatgctgacttgcccttccataatgttatgatgcagcaagaagaccttcaccagattcagccttttgatcctggacttctcagcctccagaaccatgaaccaaataaattccttttctttacaaattacccagtgtgtgatagtcttttatagcagcagaaaacagaccaagacagcatctgtcattcagtttgcaaaagtttcagccattattacttcaaatggttgtttctttctttcttccccttctggtatcaccattatgtgtgtgttacaacttttgtaattgttccataattcttggatattcttttctgtgttttttcttttggtttatctatttattttatttattccttcctttttattcttgtcagtttgaggactttctactgatatagttccaagctcaccgattcttcccttgactgtccaatccactgatgaaggaatcctttagaggtattcttcatttcagttacagtgctttaaatttctagcatttccttttgagtatttcatataattttcttttctttgttttttgtctaacttttattttaggttcagtggtacatgtacaggtttattatataggtttattatataggtgtattatctgtacacttgcaccacaggggtttggtgtacagataattttgttgcccatgcactaagcatagaaccgaataggtatttttttaaattatctccccactcctaccttcaaccctcaagtagggcccagtatctgttgttccctgctttgtgtttatgtgttcttgtcatttagctcccacttataagttagaacatgtgatatttgattttctgttcctgcattagtttgctaaggataatagtctccagctccatcaatttgctgcaaaggacacaatctcattcattcttatggctgtgtagtattccctggtatatatttaccacattttctttatccagtataccattgatgggcgttaagattgactccatgtctttgcttattgtgaatagtgctgcagcgaataaatgcgtgcatgtgtctttatggtagaacaatttatattcctttgggtatatactcagtaatgggattgttgggtcgaatggtcattctgtttttagttctttgaggaatcaccacactgctttccacaatggctgaactgatttacactcccaccagcagtgtgtaagtgttcccttttctgtgcaaccttgccagcatgttatattttgatttttaaataatagccattctgactgctgtgagatggtatctcattgtggttttgatttgcatttctctaatgatttatgatgttgagcattttttcatgtgcttgttggccacatgtatggcttcttttgaaaagtgtctgttcatttccttcacccactttttaatggggttgtttgctttttgcttgtaaatttgtttaagttccttatagatgctggatattagaccattgtcagatgcatagtttgctgatattttctcccattttataggttgtctgtttactctgctgatagtttattttgcttgcagaagctctttagttaacttagttctcttttatcaatttttgcttttgttgcaattgcttttggcatctttgtcatgaaatctttgcccgtttctgtgtccagaatggtatttcctaggttatcttgcaggatttttatagttttaggtcttacatttaagtcttcaatccaccttgagttgatttttgtatatgatgtaaggaagggatccattttcaactttctgcatatggctagccagttatgctagcaccatttattgaataggaaatcctttttccattgcatgtttttgtcagttttgttgaagatcagataattgtaggtgtgtggcattatttctgggctctctgttctatttcattggtctttctgtttttgtaccagtaccatgctgttttggttatcgtagccctgttgtatagtttgaagttgggtaatgtgatgccttcagccttattcttttttcttaggattgcctttgctattcaggttcttttttggttccatatgaattttaaaatagtttttgtctaaaatctcaatggtagttaaatagtaatagcattgaatctgtaaattgctttgggccttatggctattttaacaatattgactctatgagcatggagtattttaccatttgtgtcctctctgatttctttgagtagtgttttgtaattctcattgtagagatctttcacctccctggttagctgtattcctaggtattttattctttttgtggtcattgtgagtgggattacattcctggtttggctctcagcttggatgttgttggtacacaggaatgctattggttttcctatgttgattttgtattctgaaactgctaaagttgtttatcagctcaaggagcttttggtcatagatgataaggttttctagatacagaattatgttgtctgcaaacaggggtagtttgacttcctctcgtcctatttggatgccttttatttctttttcttgtctgattgctttggccagaacttccaatactatattgaacaagagtgttgagagagggcatccttgccttgtgccagttttcaaggggaatgctttcagcttttgcccattccctgtgatgttggctgtgggtttgtcatagatgactcttatcattttgcagtatggttcttcaatgcctagttttttgaaggtttctaacatgaaggggtgctgaattttatcaaaagccttttctgcatctattgataaaatcatgtggtttttgtcttgagttttgtctatgtgatgaattgcatttattgattagcatatgttgaaccaaccttgcatcccaggaataaagcctacttgattatgatggattaggttttttatgggctgatgtttgctagtattttgttgaggatttttgcagctgtgttcatcagggatattgacctgaagttttctcttttttgttgtgtctctgccacttttttgtatcaggatgacgctggtctgatagaatgagttgaggaggagtccctccttctcaattgttttggaatagtttcagtaggaatgatactagctctttgtacatctgatagtatttggctgtgaatcagtctggtcctaggcttttgttggttggtaggctatttattactgattcaatttcagagctcatcattggtctgttcagggattcagtttcttcctggttcagtcctgcaaaaatgtatgtattcaagaatttatccatttcctctggattttctagtttttgtgcatagaggtattcattatagtctctgatggttatttgtatttctttggggttagtggtaacatctcctttgtcatttctaattgtttggatcatctcttttttcttctttattagtctagctagcagtctatctgtcttactgattttttgaaagaagcagctcctggatttgttgattattttttatgacttttcatgtctcagtctgcttcagttcacctctgatttgtctattccttatcttctactagttttgtggttggtttgctcttgcttctctatttcttctagttatgatcttaggttgttaatttgagattctcctaattttttgatgtgggcattttatgctataaatttccctcttaacactgccttagctatgtctcaaagattatggtgtgttgtatcattgttcccattagtttcaaggaacttctttacccagaagtcattatttactgaaaagtcattcagaagcaggtggtttaatatccacataaatgaatgattttgagcaattttctttgtattgaagactattttaattatgctgtggtctgtaagtgtggttgatatgatttcaggttttttgaatttgctaaggattgttttatgttcaattgtgtggtcaattttaaagcatttggcatgtggcaataagaagaatgtatattctgctgtttttggatggaaagttctgcagatgtctattaggtccatttggtcaagtgctaagttcaggtcctgaatacctttgttaattttctgccttgatgatctgatactgtcagtagggtattgaagtctcccactattattgtgtgggaatctaagtctctttgtaggtctctaagaactgttttaatgaatctgggtgctcctgtgttgagtgcatatatttaggatagttaggtcttcatgttgaattggaccctttaccattatgggttccaaaaaagactttatcttttttgtttttgttgatttaatgtctgttttgtctgaaattaggattgtaacccctgcttttttctgttctccatttgcttggtagatttttttccattcctttattttgagcttatgggtgtcattacatgtgagatgggtcttttgaagtcagcataccattgggtcttgcttctttatccagcttgccaatctgtgccttttaattgagggcatttagcctgtttacattcaagtttagtattgatatgtgtggatttgatcctgtcatcatgatgttagctggttattatgcagacttgtttgtgtgattgctttatagtgtcactggtctgtgtacttaaaagtatttttgcagtggctggtaacggcctttctttttcatagttagtgctttattcaggagctcttgtaaggcaggtctggtggtaacgaattccctcagcccttacttgtctgaaaaggatcttatttctccttcacctagtaagcttaatttggccagatataaaattctgggttggaatttcttttctttgagaatgttgaatatagtccccaatctcttctggtgtgaagggtttctgttgagaggtccactcttagcctgatgtggttccctttttaggtgacctgctctttctcactagctgcctttaacattttttctttcatttcgatcttggaaaatctgatgattatctgtcttggggatgatcttcttgtgtagaatctttcaagggttctctgcatttcctgaatttgaatattggtctctctagcgagtttggggaagttttcatggatgatatgctgaaatatgttttccaagttgcttgctttctccccatctctttcagggatgtcagtgagtcatagatttggtctctttacatagtcttgtatttcttgtaaattttgtgttttcctttcaattcttttgtctttatttttgtttgactgtcttatttcagggagccagtcttcaagctctgagattctttcctcaccttgttctattctgctgttaatatttgtgatttgattgcattatgaaattcttgtagtgtgtttctcagctcttatcaggtcagtttggttcttttttatactgactgttttgtctataagcacctgtatatcctttcttgtgatgcttagcttccttggattgggtttcagtgttatcctaaatcttgatgttcttcattcctattcatattctgaattctatttctgttttttcagctctctcatatcagttaagaacccttgctggagaactagtgtgtgcagtcatttggaggaaagaagacactttggccttttcagttaccagagttcttgcactgttttttttttctcatctgtgtgtgtgggtgttcctttaactgtggtgtaaattgagtacagtcagtagacttcttttctggatgttttcagagggctgtggctttatgcaaggactttatttgtaactgaattcttgtctttggtttcgcaggggagtatgttcgcaaagtatttttggtgttgaagttttgcggtatgatctagtatgtggcacttatgcataatggtcagtaggtaggctcttgcgtagtcatgtggctcctgtgtatttctctatggttgcagctgtgtccctctcaatgctctgaaaatattggctcctctcccacttgagtgctggctgcagatctcaacttggcactcccaagctgtacactgtggctctggggtgatctcaggctttctgttcgctccccagtttggagacagcagaaggagggaccttagctgtggttgtggcctagggtctttcacttgtctcccgggcgctaccccagagacatgtagagctgtgatcaatcaatgtgattggcctgggatggggaggctgtacttacgtgggatcaacctggaggggccctacctggtgatgagcaagaggggtgggtgggacctgtgggagacagactggtctctccttaaagcaactgcagtttgctggaggtggggataaagcactcagggtctttactccttccccagtttgaggacagtaagagcagttccactgcagaggcagtggcagaggggctttcagttgcccctaagagttctacctccaagaaacacagagctgctgctactgggagtgttcagccaggggctagatcagctgcactgctgtcctgaggtaggggctctacttgttggggagcagggtatcatgggctcacagggaggagagaccggctcctctccgtgtggcgactttgttgtgctgtaagcttgcgtgaagccctcgagctctttgtttctttccccaactgagggtagcaggggcagaaactgctactgtggcagtggcagaggggctgttggttgcctccaggaacctcttccaaagaaaactcagagccactaccagtggggtatgctcagcagtgagtagggcagctgttctggagttgtgagcctggggccctgcctggtgaagagagggggatgaagacgcctaaggaagaggaactggactcccttccatatggtggctgcagtgtgctggaagtgccaatacaacaactaggccctttgttccttccccggcctaagggtagttagggcagtaccactgcagctgcagtggtggaagggttttgaattgactctgggatttcctacttggagaaatgctgagccacctctaattgaagtgctcaggtgggtgcagggtagttctgctggagtcccaggttgggaggccttgcccagtgagaagtggggacagatacctgcatggggaacaatgtggccacttttccatggagtagctgcactgtgctgagggtctgcaccagtgcctagttaccatggactcgtgagagcttgaaggtagcaaaggcaaggactgcaagagagcaaagatgttggcttgctccttctttgagctctgtcccagagatctgcagagctgccaccagcatgagaaccccagcgagggggtggctggagtcccaggttgggaggtcctgcccagtgggaagaaacgggattggagacccacatagaaaacagtctggctgctttttttagggtggccacactgtgctgggagtctgtgccacacggtagttgcctgggactctccagaacctgaagactgcaagattacaaagatggcagcccacctgtctgggaggtgaggagttgttacaggcctaagagccctagtagggggtaactaaagtccagaccagtgtgtctcagcctgtgaggcttgcagaccttcattgttcagcgccctggattcagcacctttcttggggttgtataagtgaggcttacctccccgcaacctttttttttgagacagagtctagctctgtcccccaggctggagtgtgcagtggcacaatctcggctcactgcaagctccacctcctgagttcacgccattctcctgcctcagcctcctgagtagctgggactacaggtgcccaccaccatgcccatctaattttttgtatttttagtagagacagggtttcaccgtgttagccaggatggtcttgatctcctgacctcgtgatccgcccaccttggcctcccaaagtgctgggattacaggcgtgagccaccgcacccggcctacctccccttttaccagagctgcagctgctaatgccaggatgcctggggatccagggctccttgggactctgcatatatgtgagtgtggctctgtccagtctccacatagctctgtgtatcagtccgaaggccctggtggagtgggctcacagggggatctcctgatcctagagttccaaagatcctaagtgtggattcctgaagtttctcactcactcaccatttcccatggagagggaacctcccagatggacagagatcctgtcttactcctctctgttcttcgtgggtcgagttgtttccttgatgaattccaatatgttcacctgcatgtttcagttgaagatgtagtgtttaattgctactgtttcttctctttgtgagtgtggcatactctagctacttctagtcagccatcttgtccttccccctcattcttcatagggttttcaaacctctctgtttatattactcattttttcttaaatgttgtccatttttttcccactagagcccttatcatactagtctgatagttccaaaaatatctgccatatctgagtcaggttctgatgcttactttgactcttgagactgtattttgcaatttaacatggcttccaattttttgttcaaagctagacatgatatattaggcaacagaactcagtaaaataggccttaagtgtgaggctttatgtttatctgtctaagaatcaggctatattcaatatttgttgtagctatagatgtcaaactctaaaatttcttctgctatccctgctttttcctattctgttgtctttgggttccccggagattactttttatataaggtctgatacttaacagttgttccagctgtaattccctgttattagacattagcctgattgatgtagtggtaagcagtgggtacaaggggtatatattctattgtcttatgattaggtcttagtcttttagtgacctagtacccctgtgctatgaccttcacaagtttttctcagttttttcttcccactaggtgatacgggaatcctagatggggctgaattggttattttccttaccctgtatcaggctaatgggtactagatctgggtatttcccttctttacagtcggataggcattgataaaacccaattcagttgggttctggtaaaatagtttccctttagggaagcagggatttttaaggagaacagaatactctgggcatatttcaaatggttactcccccctccacacccctgcccccaccgccaacccctgtcttcctactagaaacatgaggggattttatttatttttatttttatttttattattttttttaccagtctttatattgagaacctgtcagggctcctggaggcaaaactcacaaagatttgggagcctctctgagaggaacctccagatattttaactgtaaagctagtccacattgagccttccactactgggtctagcagtgggcgtctgctcctgagattctgatgtcagtaagctgtggttttcagtaaccacattttttctcaattttgggggcagtggcttgtcctgtgacctcaattctctgatggatctaagaagagctgttaattttcagtttgttcagcttttttcttatactaacaatgagagtaatgacttccaatcactttacatttcagactggaaatcagaagtctctgttgtattgattttttgagttctcatttatgtgactgaacatttcttgttagaagtaatcttacttataagttccttaaccatagtgccatgtaggagccataatgtcatccttagaaaaaacaagtttgagaacagctttctttctttgtattccttatcaatgaaaggtataacagaagcactgcccaatataattttagctcttatatttatgcctttcatatattcggagttaatttttatatatggcatgaggtaggagtccaagttcattctttgacatgtagctttctagttgttccagccatattttttgaagatattctttcacattttatggtcttggcaccattgttgaacttcagttgtctatagatgtgtttatttctggccattcaattccattccattaatctacatatctgtccttatgtctgtacctccctgttttgattattgtagctttgtagtatgttttaaaattgggaattgtgagttctccaactttttttttttcaagattgttttggctatttgaagccccttgcaattctatatgaattttaatatctgcttttccatttctgcaaaaaggggctttgtaattttgatagtgatgacacttgtccttgaagctttaagcaagaactatatagcctctgttcagtttgattgtgaggcttttttaaatttagcaggttacattgtgaatgatgtaatttcataggcaaagtccatttttgccatgtaaggtaacatattcgcagattccagggattagaaaattgacatgttgtgggggctgatacattatttagtctactgtactacttacagtaaaggcagtggtcatagaatcaagcaagttatatatgggtaaataaatgtggtaaaataggctatccatattttgcagaagctgaaattccagtgataaacacaaggtagagacttttaaaattttactactttcatagactctgtgtatcagcggtttgcaaccaccatatgtgttagttggaaataattcatcattattaatccttgtggggagaaattctgttaattagatgtttgggaaatgctattatagtttgctgtacaaagaatactagcagttatctcttacaaaacattgataataatatatttattttcccatacctacttaaaaattacaaatagcattttcctagaataaagggtctaggaaggacacaggaaaagagggggctattgctacttttcaaaagactcagtagacattagggaacatatttaagcagtcagtatatttgtagaaagcttgttgagttttttttctatccattttgtttctgtatgccagttttatcacaaaataatacttatgagttcacctttcctttctgagcaataaacaagcttaaggtatctaagccttgaaaattggccttggtactattctctaaatttgaagtaatgtctttgttcttcaacaaggtcttaccagctattgtcttatagccttaggatttggggcacacagcagcaagtttagggctgagtgagtacggactgactttgtgatatgctcagtatcaatatacccagcaatttcccaagtaattccctaaagaacagttctagtataccttcctactcctaaaaatcagactgcttttcctattttcctgttgttgtaacaaattaccataaatttgattgcttaaaacaacatatatttattatgttactattctagatgccagaagttcaaatttagtcttgctgggtttaagtgaaggtgttagcagggctggctccttctggaggctgtgagaggagaatccgttttcttgcctttttttcagcttctgcctgtgttccttggcttataatctctttctcacatcatttcagcctttaattttattgtcccacctctttctgtctttgaccttcttgcctccctcttttaatgactctgcttatgttgggactaactgcataatcaaggatagccttcccatctcaagatccttaacttaattatatgagcagagtccctttttgccatgtaaggtaacatattgacagtttccagggattagaaaatggaatattgtggagagggatacattacttagtctattatacaacttacagtgaaggcagtggtcacagaatcaagcaagttatagataggtaaataaatgtggtaaaataggctattcattgagttttgggcattatgtagatatctttaacattcttacttccagttattggcattttaccatctatgaattcacatgggtatatcataataaggggaaaattgatgagtgtcaaacactccagatttccttaccaaaagggagttgtgaaatttcacagttctgtaaattttacctcacaagtgaattaaaaaacaacttggtaacctgtcttgtggtagagttcctataaatatgataggagttcatttgaatactctctttaccatgttaatcttctgttatgggctgaatcctgtccaccccaaaattctcatgtttaagcactaatctcaagtacttccaaatgtgactatgtttggagacagggcctttgaaggggcaattaagttaattagggtgggtcctaattcaatctgattggtgtccttataagaactggaaatttggacacacagaaatactggaggtgcacatgcacagaggaaacaccatgtgacgacacagcaagatggtggtcatttgtaaaccagggaagggaggcctcaggacaaattaaacctgccaaaatcttgatcttggatttccagtctctaaaattatgggaaaaaaaatttatgttgtttaagtcacccagcccgtggtattttgttgtggcagcactaacaaactaaaacatcctcaaacatttatgtatttgtttggcattttacatcagattggaaaaaaaggaagccttgtgtttatggtaaaagtatagagtttcatagaagtttagactttcaaacttgataaatcctatcaaagctagagcacttttccagtattatgttcaattccagtgtagcagtgtgtacattagcttactacctgctttagatggcaaaatagaaaattaaatatagagagtacccagaaataaactcacacatttatacttcattgatttttgacaaaggttccaagaatacacaatgagggaagaacaatctctttaataaatagtgttggaaaaactggatatccacatgtagaagaatgaaattagacccttatcttacaacatatataaaaatcaactcaaaatgaattgaggacttaaacattagacctgaaactgtaaaactactagaacaaaaaataagaggaaaactccatgacataggtctgggcatttattttttggttacgaacccaaaagcacagggaacaaaagcaaaaataaacaagtgggattacttcaaactaaaaagcttccgcacagctaaggaaacaacagagtgaagagacaatctacagaacaggagagaatatttgaaaaccatatatttgttaaggggttaatatcaaaaatacataaggagctcaactcaatagcaagaaaacaataaccttatttttaaaatggcaaaggacctcaatagacatttctcaaaagaagacatacaactggccaacagatatgtcaaaaaatgttctacatcactaatcatcggggaaatgcaagttaaaaccacagtgcagtatcactcaaacctgttagaatggctattattgaaaagatgatagataacaagtgtcgatgaggatgtggagaaaaaagcactcttgtacactctagaaatataaactagtacagccattatggaaaactgtatggagattcctaaaaaaaactaagtatagaactatcatgtgatccagcaattccacttcttggtatatgtacaaaacaactgaaatcagtatgtaatatatacaaatatatatatatgtatatatatatatgtatatatatatatataatactgatttcagttgttgatatatatatatatatataacatactgatttcagttgttgatatatatatatatatatatcaggcacagaaagacaaatactccatgatctcgcttatatatagaatctgaaaaagtcaaactcatagcagtagaaagtagaatggtggttaccagaggatgggagcgagaacaggaatggggatgtgttggtcaaagggtacaaagtttcacattgacaggaggagtaagtttttgacatttattgcacagtattgcaattatagttaataattatgaattgcatatttcaaaattgttaagagagtacatttcgaatcttctcaccaaaaaatggtatgtgaggtgatggctatgttaattagccaaatttattccatcatgcatacatatttcaaaacaatgtattgtatatgataagtgtatacaattttgtgaattaccaaaataaaaacaaacaaaaccaaaattaaatttgaaatgtacattcaaagtaaacctagaatgaactgaacttactacaaacaaaaatctccacctctctctttctccccccattcctattttaattgaattacagtcagtaatttagggaagagtgggcaggtagctctaaaaaagcaatttgaattaaaacttttaaaaacctactgggtgagacacttgccagccaaaaatattgtctctaacaaaataatttgtctaaatattttatgggggtgcttctttgtctgattggtcagtgatagatgcttatagaagcataatgtctcttcccagattttaaatatagtgtaaactgatatgatttatataatcaacagaaaaccatatgttcaaggggtctttatattttcaacaaattgaacaatctgttttgtcccaaacactgtttctaggttctaggaatacagcatagaataaaacaaaacatcatcctcatggagcttacatttagggatgagggaaacagataataagaaattaaatatataaatatgtaatattaagtggttgtgaatgataccgagaaaaataaaacagggtatgagggtgttggaaggagggatactattttagataggatagtcagagaagttcattctgagcaaatacctgaatgaagtgatggagcaagtcatgaggttatctaacagataaatattctaggctttgggaacaacaaatacagtggtccttaggtaggaatgtgtttggcttgctcaaaaaacagcaagaaggctagtgtggctgaaatggaggaagcaaggggagaatggtgagagatgattttaaaatggtagccaggggccagatcatgtaagatattacaggccatggaaagaagtttggattctaagtcttacagaaagccactagaaggttttggcaaggggagctggagagctgtgagatattatatatatatatacacacacatatatatatatatgtgtgtatatatatatgtgtatatatatatgtgtatatatatatgtgtgtgtatatatatgtgtatatatatatgtgtgtgtgtatatatgtgtgtgtgtatatatatatatatatatatatatgctgtctccatatatatatatggagagagagagagatagacagtcttgctctgtcacccaggctggagcacagtggcatggtcacggctaagtgcatgcaacctctgcctcccaggttcaggcaattcttgtgcctcagcctcccaagtaactgggactacaggcatgcaccaccacacacagctaatgtttgtatttttaatacagacggggtctcaccgtgtctcccaggttggtctcaaactcctggcctcaagtgatccacctgcctcagcttcccaaagtgctaggattacaggtgtgagccaccatgcctggccatgacttatatttttaaatagtaatcctggctactgtgtagagaatggactctagagaaacaagaattgaggcaagaaggataactagtacctataaaacaattgcagtggtccaggtaacagatgatattgatttggaataagatctcagctgtggaagtggtggtaagtgtccagctttgaaatatatttagtgggtagattcaatggatgttgtagatgaatcaaatatagagtaagagaaaaagaggaattgattctgatgctgagcagctcagtgaatacagatatcacttattgcatttcagatgccttttagacatccatgtcaagatggaaagtaagcagttggagatataagtttgggactttggagataggtccagactagaggtagaaatttgagaaacatgaaggtataggtggtatttaaagccaagaggttggatgagatgactaagagatgtagatagtgtgagtagtaagagaggaagtccaaagattgagctttggcaaggatgccctctctcaccactccaattcaacatagtattagaagtcctatccagggcaatgaggcaagagacagacataaagggcatccaaaataggaagagagaaagtcaaactatctctttttgcagacgacatgattctatatctagaaaaccccatagtcttggccccaaatttcctttagctaataaacaacttcagcaaagtttcaggatacaaaatcaatgtataaaaatcactagcattcctatacaccaacaacagccaaactgagagccaaatcaggaaggcagtctcatttagaattgccacaaaaagaacaaaatacgtaagaatacagctaaccagagaagtgaaagatctctacaatgagaacactgctcaaagaaatcagagatgacacaaacaaatggaaaaacattccatgctcatggataggaagaatcaatatcattaaaatggctattctgcccaaggcaatttacagattcagcgttattcctatgaaactaccaatggcatgttttgcagaactagaaaaaaactattttaaaattcatatggaaccaaaaaacagtccgaatagcaatggcaatcctaagcaagatgaataaagctggaggcatcacactacctgacttcaagctatacgggctacagtaaccaaaacagcatggtactggtacaagaacagacacatagaccaatggaacaaagtagggagcccagaagtaaggctgtacacctacgaccatctgatttttgacaaacctgacaaaaacaagcaatggggaaaagactccctagtcaataaatggtgctgggataactggctagccacatgcagaaaattgaagctggacccttacttacatcatatacaaaaaatcaactcaagatggattgaagacttaaatgtaaaacccaaaactataaaaactctggaagacaacctaggtaataccattctggacataggaacaggcaaagatttcatgatgaagatgtcaaaagcaattgcagcaaaagcaaaaattgacaagtgggatttaattaagagcttccgcacagagaaagaaactgtcaacagagtaaacagacaaactacagaatgggagaaaatatttgcaaagtcttcatctgacaaaggtctagtatctagtatctataaggaacttaaatttacaagaggaaaacaaccctattcaaaagggggcaaaaggcttgaacagacagttttcaaaagaagacatacatgcggccaacaagcatgtgaaaaaaggattaatatcactgattattagagaaatgcaaatcaaaaccacagtgagataacgtgtcacgcaagtcagaatggctcttattaaaaagtcaaaaaataacagatgctggcaagattgtggaagaaaaggaacacttatacactgtttgtggaaccattgtggaaagcagtatggcaattcctcacaaaaaagcagaaccaccatttgactcaggaatcccatcactgggtatatacccagaggaatataaatcattctactgtaaagtcacatggacgcgaatgttcattgcagcactattcacagtggcaaagacatggaatcaacctaaatgcccatcagtgatagaccggataaagaaaatgtggtacatatacacactggaaaactatgcagctactaaaagaattagatcatgtcttttgcaggaacatggatggagctggaggctatcatccttagcatactaatacaagaacagaaaaccaaatactgcatgttctcacttataaatgggagctaaatgataagaacttatgaacacaaagaaggaaacaacagacactggggtctacttgagagttgagggtgggaggagggagaggagcagaaaaagtaattaataggtactgggcttaatacctgggtgatgaaataatctgtacaacaaactcccatgacgtgagtttacctatgtaacataacaaatcttcacatgtgccccggaacctaaaaggtaaaaaaaagattaggctttgcggcatttcaaagttgagatacaggagatgataataaatcatcaaaaacaaaagttaataaggtacagtcaaggagtagccaataaggtaggagaaaaaccaggaacatataatatgttagaagccaagtcaagaagatgcttcacagaggagggagtgatcaaccctgtctaacactactgttaggtaaatgaccaaatatcatttagtttcccaggacagtcctggtttatgcctgttgtacaggaataattgttaataagacccttttttacttttagaagtgccttgatttggatgataaattatatgctccctatgatgataggtcaacaagaggattgagaattgagtattggatttggcaacatggagatcattggaaatcttgaggaaagcagtttcagtggagcattcaacttcattggattgtaggataaaatgaatccaatgaaaaccaacttcattggattgtagaataaaagactggagtggtttgaagggaaaaagaggagacagtgtcataaacattgacaactattttgaggggttctacagcaaaacatcagagaattggggcattagctctggaatgatataggtacagggagaattttgtttttcaagatagataatagtacagcatgttttcatgctgatgagaatattccaggagagaggaaaatttgtgtagactatttttttaaagagcagtttaaggttcacaaaaaaagtgagaggaaggaacaaagctatcccatatattttctgcccccaaccatgcatagtctcacccattgccaatattccccacaacagtggttccatctgctaaaattgatgaacctacattgacacatcattatcacccaaactccactgttcacattagggtttgctcttggtgttctatgttctatgggtttggaaaaatatatactgtcatgtatctatcattgtattataatacagagtattttcaaaagcctaaaaatcctctgtgctcagcctattcattcctccctccccctaacccatggcaaccactgatccttctactctttccatagttttgcttttacatcatatagttggaataaaacagtatgtagtctttttagactggtttatttcacttattaatatgcatttacatttcttccatgtgttttcatggcttgattgctcatttcttttgagtgctgcataatattccattgtctggatgtaccacagtgtatttatccattcacctactgaaggacatctttgatgtttccatgtttgacaattatgaataaagctgctagacacatcaacgtgcaggttttggtttggatgtgttttcagtttatctgggtaaataccaaggagagcaattgctgaattgtatgctaagtacatttagttttgtaagaaactgctaaattgccctccaaattacctctacaattttgtattccaccagcaatgaatgacacttcctgttgcctcatatcctcaccagtatttggcactgtaagtgtttggattttggccatcctaatagttgtgtattggtatctcattgtttttataattagcatttacctgatgacatatgatgtggaatgtcttttcatatgttcatatgccatctgtatatcttcttaggtgaggatatatctgttaagatcgctggcctgtttttaaattgtcgtgtttgttttcttattgttgattttaagagctcttagtatattttggttaacaatactttcatcagatatgtcttttgtaagcattttctcccagtttgtggcctcagcctcttgacagcatgttttgcagatcagaaatgtttaattgtaatgaagtacagcttattaattctttttttaaaaaaaacacttgctttttatgttttttagtaatacgtagtatttttacgtattttggggtacatgtaatgttttgttacatgcatagaatgtgtaattatcaagttagggtatttagggtatccatcgcctctagtatttgtcatttctatgcgttggaaacatttcaagtcctcttttctagcttttttgacatatataatatatagttgttaactatagtcaccctataatgctattgaacattagaacttattccttctatctcactgtatgtttgtacccattaagtaacctctcttcatcacccctcatacacccaccttttttcatggattattgcgtttagtagtgtatctatgtcatcatcaaaccagggtcatccagattttatcttatgttatcttctaggagatatactttatatttaagactgtgatctatttttagttaatttttgaaaggtataaggtatgtatctagattaatttttttgcatgtggatgtccagttattccagcataatttattggaaagactgtcctttctccattatattgcctttgctcctttgtcaaagatcagttgaccatatttatatggatctatttctgggctctctgttctgttgcattgctctctatctgttgtccttcctttcactgctaccatactgtctttgattcctatagctttacagttagtcttgaagtcacaaaagcatgggatcccccattagtggatcgtcctggaatttttaactctcagatttgtacacacctagccttcagcaatttgtgaattacagttcagattttcctaccctagcactggttcccaaagaggtttctgttaaagtatgttgtgattctctccatctacgactttctcttcctatttttgggacagaggtttgtcttgtgacctcacttctcttacagatctaagaataatggttgatttttcagtttgttcaactttttacttgttaggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttttgtgtctggcttcttttactttgcataatgttttcaaggttcattcatgttgtagcatgtatctgaacttcattctttttctggctgaaaattttattatatgtatgtattacattttgtgtctctattcatcacttgatggatatttggatagatttaagtcatttgtcttttgtgaatagtgctattaatattatgaacacttgagtacaagtttttgtttaaatacctcttttcttttttcttggatgtattatctaggtgaagaatggcaagatcatatggtaattctatttagctttttgaggaactgccaaacctttccacaatgactgcacaattatacatttccagtagggttccagtttatccatattctcaccaatgcttttatttttctgttttttaaaattatactgatcataggaggtgtaaagcagtatttcagtttggttttgatttgcatttccctaatgattaatgatgttgagaatcctttcacatgcttattgaccatttttatgtcattttgggaaaatatttattcacatttttgcccattttttagttgggttgtctttttttgctgttgagttgtaggagttctttatattttctggatattaaaccctcatcagataaattatttgcaaatgttttcttccattctgttaattttcttaatgttgtcttttgatgcacattgtaaaaatttttaaaatcaatttccattttcttatttttttattattatgctttaagttctgggatacatgtgcagagcgtgcaggtttgttacataggtatatacgtgccatggtggtttgctgcacccatcaacccatcatctacattaggcgtttctcctaatgctatccctccccttgccccgcacccccgagcagaccccagtgtgtgatgttcccctccctgtgtccatgtgttcccattgttcaactcccacttgagtgagaacatgcagtgtttggttttctgttcctgtgttagtttgctgagaatgatggtttccagcttcatccatgtccctgaaaaggacatgaactcatcattttttatggctgcatagtattccatggtgtatatgtgccacatgttcttcatttccagtctatcactgatgggcatttgggttggttccaagtctttgctattgtgaacagtgccacaataaacatatgtgtgcatgtgtctttatagtagaattatttataatcctttgggtatatacccagtaatgggattgctgggtcaaatggtatttctagtatttctagttctagatccttgaggaatcgccacactatcttccacgatggttgaactaatttacactcccaccagcagtgtaaaagcgttcctatttctccacatcctttccagcatctgttgtttcctgactttttaatgattgccattctaactggcatgagatagtatctcattgtggttttgatttgcatttctctaatgaccggtgatgatgagctttttttaaatatgttttcatatgtttgttggctgcataactgtcttcttttgagaagtgtctgttcatatcctttgcctttttgatggggttgtttttttcttgtaaatttgtttaagttctttgtagattctcgatattagccctttttcagatggatagattgcaaaaattttctcccattctttaggctgcctgttcactctgatgatagtttattttgctgtgcagaagctctttagtttaattaaatcccatttgtcaattttggcttttgttgccattgcttttggtgttttagtcatgggtaaaattttttgatgaagtccatttaatctattttttttcttttcttaatcttgcttttggtattatatccaagaaaccattgccaaatctaaggtcatgaaggtttacccctatgtatttctattagtccgctctcacactgctatgaagaaacaccgaagactggttaattcataaaggaaagaagtttaattgacttacagtttcacattgctggggaggcctcaggaaacttacaatcatggcggaaggcaaaggagaagcaggcaccttcttcacagggtggcagtatggagttagtgcaagcagggtaaatgccagacacttacaaaaccaccagatcttgtgaggctcactcattatcacgagaacagcatgggggaagctgctctcatgatctaattacttccacctggtcctgcccttgacgcatgaggattataggggttatgcaggttacaattcacgatgagattttggatggggacacagccaaaccatatctctattctaagagcgtgatacttttagctcttatatttatgtctttaatctatttggaattaaatattacatatggtatgaagaggagtctagcttattttttatttcagcaaaatattcattatattacataatcatgtaagttatatgcagtgaaatctcccttccatggtatgatacttcaatagattaaccaagtccccaaaataggtaggaagaaaaatattgtatccactggaactgcaagatgaacagtatgtagcctttttacaaggctttttttacttagtaatatgcatttaagtttcatccagatcttttcatggcttgatagctcatttatttttagtggtggatagtattccattttctggatatgccgcagtttatgttaatctagtagaggacatcttggttacttccaattattggcaattataaatgaagctgctagaaacatccatgtgcaagtttttgtgtggacatacgttttcaactcacttgcatgaataccaaggagttccacttcggtattatttgctaagagtatatttagttttctaagaaaccatgaccatcttccaaagtggctataccatgttgcattcctaccagcactaaataagtttctgttgctctacctcctttgcagcacttggtggtgtcagtgtcctacatgttgaccattgtattaagtgtataatggtatctcactgttgttttaatttgcattctcctgatgacatacaatgtggagcatcttttcatatgtttatttgccatctgtatatcttcttaggtgaggtgtctgttaaggtccttagcccattttttaatcctgtttgttttcgtattgttgggttttaagagttcttcatatattatagataacagttctttatcacatatgtcttttgcaaatattttctcctggtttgtggcttatcttctcagataacagtgcctttctcagagtagaagtttttacttttaatgaagtcccgctaaccaataccttattttgtgaatcatacctttggtattatatttagagaattgtcaccctacacaaggtaatctagacttttagaaaatgtaaccatctaggagctgtagttttgcattttacttttagttctgttagccattttgagttaattttgtgacatgtgtagagtctgtgtctagattttttttgcatgtgggtgttgagttgtttcagtataatttattgaaaagactctcttttctctgttgtattgcctttgctcctttgttaaagatcagttggccatatttacatgggtctgtttctgggctctctgttctgttgcatttattcgcctgtcctttcattgataccacactgttttgattactatagctttatagtaatttttaaagttgggtagtgttggtccaactttgttcttctccaatagtgtgtcagctactatgggccttttgcctctccatataaactttagaatcagtttgtcagtacttacaaaacaacttgctgcaattttggttgggatcgcactgaatttatagattaaatttggaagaattaatatcttgacaatattgaatcctcctatccatgtacatggaatatctctgcatttatttagttattttatttccttcatcagtgtttcatagtttcactcatatagatattgtgcatattctgctagatttatacctaagtgtttcatttttaggtgctaatgtaaatgttatcatttttaaactacaaattctactttctcattgctcgtatttaggaaagtcatttttaaaatatattaatcttgtatcctgcaacgttgccataattacttatcagttccagaagtttttttgttgttgtcagttctttcagattttgtacatacacagtcatttcatctgcacatgaaaacagttttctttcttcccagtcagtataactttaatttcttttttcttgtctttattgcattagctaggacttccattatgatgtagaaaagcagtggtgaaagggaaaatatctgcctcattcctgatcttactgataaatcaagtttctcaccattaagtatgatgttagctgtaggtttttggtaaatatcctttatcaagttgaggaagttctcctctatttttagtttgctgagacaactttattcttttatctgtggatatctggttctctcattaccaccaccacatatagagaacggacaagatttttaataaatggtgattgcgtcctctattagtttgttttcatgctgctgataaagatgtacccgaaactgggaacaaaaagaggtttaattggacttacagttccacatggctcaggaggcctcagaattatggcaggaggtaaaaggcacttcttacacagcgggagcaagagaaaaatgaggaagaaacaaaatcagaaacccctgataagcccataagattttgtgagtcttattcactatcacaagaataacacgggagagaccaatccctgattcaattacctccctctgggtccttaccataacacgtgggaattctgggagatacaattcgagttgagattttggtggggacatggccaaaccatatcatttcacccctggcccctccaaatctcatttcctcacattttaaaaccaattatgtcttcccagcaatcccccaaagtcttaactcatttcagcatcaacccaaaagtccacagtccaaagtctcatatgagacaaggcaagtcccttctgcctatgagcttgtaaaatcaaaatcaatctagttacttcctggataaaacgggggtgtaggtattgggtaaatacaaccattccaaatgggagaaattggccaaaacaaaggggttacagggcccatgcaagtctgaaatccagtggggcagtcaaattttaaagctccaaaatgatctccttcaactctaggtctcacatccaggtcatgcagatgcaaaaagtgggttcccacagtcttgggcagctctgccctgtggctttgcagggtacagcctccctcctggctgcttacatgggttggcattatctgtggcttttccacgcacacagtgcaagccgtcagtggatctatcattctggggtctggaggatggtggccctcttctcacagctccactaggtggtgcctcagtagggactctgtgtgagggttctgaccccacatttcccttctgcactgccctagcagaggttctccatgagggccccacccctgcagcaaacttttacctgggcatccaagcgtttcttacatcttctgaaatataggcagaggttcccaaacctcagttcttgacttctgtacacctgcatgctcaacaccacgtggaagctgccaaggcttgcggcttccaccctctgaagccacagcccaagctgtatgttggcccctttcagccacagctggagcagctgggacacagggcaccaagtgcccaggctgcacacagcatgggggccttgtgcccagcccacaagaacacttttcctcctgggcctccaggcctgtgatgggagggactactgggaagttctccgacatggcctggagacatttttcccatggtcttggggattaacattaggctgcttgctacttatgcaaatttctgcagctggcttgaatttcttcccataaaatgggtttttctttcttatcgcatagtcagcctgcaaattttccaaacttttatgctctgcttctcttataaaactgaatgcctttaacagcatccaagttacctcttgaatgctttgctgcttagaaatttcttctgccagataccttaaatcatctctctgaagttcaaagttctacaaatctctagggcaggggcaaaatgctgccagtctctttgccaaaacataacaagcgtcacctttgctccagttcccaacaagtccctcatctccatctgagaccacctcagcctgaattttattttccatatcactatcaacattttgggcaaagccattcaacaagtgtctaggaagttccaaactttcccacattttcctgtcttcttctgagccctgttccaacctctgcctgttacccagtttcaaagtcgcttccatattttggggtgtcttttgagcaacaccccactctaccggtaccaatttactgtattagtttgttttcacgctgctgataaagacatacccgagactgggaagaaaaagaggtttaattggacttacagttccacatggctggggaggcctcagaatcatggcaggaggtaaaaggcacttcttacatggcagtgacaatataaaaatgaggaagaagcaaaaatagaaccccctgataaacccatcagattttgtgagacttattcactatcatgagaatagcactggaaagactggcccccatgattcaattacctccccctgggtccctctcacaacatgtgggaattctgggagttacaattcgagttgagacttgggtggggacacagtcaaaccatatcaagtcccatcaatggaatgtgagtggaaatgatgtgagcatttcctcaccatggattttaagaaggaaatcaactacttctattctcctttttctcatttgctggctggatgcaggctgtggtgaggccctatcatgatgaggcaggaagtgatggttagttaatgagaaacaacaacaaaaggtagtgtagttttctcattattttttctattatagaaagcaatttgacattccattaatttctaatatttattgacattgtggaaattcaggttttcttctccctgtaaagctaattagctctccttgccagctcctatagttctaaaaatcctcaaggggtatttcctatgtcctgaatttttggggttttcctgtgattcttccagttgttgctgccattctaagctgtattgccaggcatttaatgtcctctaattaactgttctctctaatttcctaactccacctatacacagggttttcatgatgtcagatctgagtagtagtcaaaagtttaaatccatgttagaaaggaggatattttcctctctttaggttatgctttattaatgggttccttacactggagcattacagagtttacttaaagacagttatttcctggatatgtataaacctgcctttgctatgacagatatacagttgagggtttgtgttggaataggcacaaataggagttctataataatttcagtgttgctattagaatatctatacttccctaatggcaaggcattgttcatgggctagggtccttgtgcgtgacttggtttttcttcaagattaattctcttgaagtagaccccaccccaaatatgacctgaaaatattcttgggccaggcctccccaccagttctgcaaatgtaccctgtctcaagaagtagagacaggctgagatctttcccatagcattttcaggctacactgaaaatagacatctgttgggccaatttcaccatatagttcaccagaccaacctcagcctagttattcctgactacaggggactttaatttctgtgtacaacctttgaaactttgagatagaagaaggggatacattataagaaaacacagggtttggctcagcctcgaccaaaagagaagtctcagaaggaagctttgcttgaggcccataaaggacagtatagaggcaagtaaaactaaataggcaaaaacaagtccatgaccatggtgattgagacagacaagaggagaacaggcaagtgataggctggtgtgcaagttcatgagcatgcttgggggtggtgggtgggatttggaagaaaacagtgagtatgatgagtgagcacagttgcatctgtatcatggacttaatgcttatggattatttggctctgacatttagatttcagtggtaagtcagggttacacaggtgctagtgtaggcactgaggagtagaaagatgactgttgcaatttattgaactagaatcaattataggaggaaataaatagtgcttagcagtcagagtatcttatttcaatcttttatttgctcaaaggttttaaaaataataatctatttgatacatacccatacaaagctaacatatgaaaagcttaaagtagggcctttatcacttcaatacatactaaccaatacaagaccatgttttctaagagtactgacaacaaattgtccaacacacattttaaagtctcacacagtaaaatttgtcagcttttggtagaaccattcctctgtcagtaaatatcttggaataaagatcctagcacctgcagaattaccacagaagcttgtgcaaatgtgattttggacataattataaaacagtaaaggggattggtggctgtattggtgagatgagccctaaaatatttctcagagactgaagcacaggtaaagaaaggcaatgggaatagaattcatcaggatggtgagtgtattctgttcctactcctgctattgttaccaaccaacacagtgggtgggttcagtcgtttgacatcaaccccatgatcacagcaaggatttagtaaggggatttattacttgtaacgaagtaatgagaccaccagggatacttcccaaaataatgtctccctgagatgggggctgggtcaggttttcataagcattgggtattaagggtatatcctgatggctttggatcttacaatgaggtgatgctgagaggcatgatctgactggatcctgccatccagtgtccacttcttaattcagccctggtcctaattcaaaacacttacattctccctctgattgcatgcttggttcatctgaggatgctcaggtaacatgatctgagggtccccggcaactgaaagacaatgcacaactttgttatataaaagttaaaccagataggtctggtgctgctaccctgtaaccagttaccatacatggaatggcttaaaataataccaatttattattatcttacagtcctggaaggttggaaatcttcaaagggcttcaccacactaaaatcaagatgttgccagaggagctatccctctggcatttctagggaagaatctgtttctttgtcttttccaggttctggagacagcctgtatttcttggatcttggcttccttccatcttcaaagccaacgatgaccagtgtagactttctatgctgcttcaatctgacatggagtccctgccttccacatctaaagtacccttgcaattacattggccaagataacccagaataatcttaaattaaactcagctgaatagcaatcttaatgatcctttgtcaggtaatataaaatggtacatgttctggagaacaggacatggacatctttaggggaccgttacctgccaaacacaatgagggtagtgtctaaatgagttttcaaatggacaacagtaacaacatcaacttggtgtttaaccacattgctctgtctgtcccatgcaggaagcagggaaaggaggggctcaagagtagaggacggatgtgggggtgaaagaagaggattcaaatgagccaggttgctttgtctcggggaggggggtgcacggtgggatcctctcctgagaatgactgctgaaacaataggtagttgtggcaggtggcggagatccaagctggtttgataccagccacatttccacactgccaaatatcatggcaagagaagacttgacagggaaccgaagagaagccaggaccatccctacctggcggcatcaaagagagaggactgttatgacctcctgcgggtcctgacagggaaaggtcctcttttgggggcaactgtggggacggtgcaatgccaacgtgagccaccatttgaaatgagaaacagcggtgtggcagaaagaaatgagtctggtgcagaccagtggttggtttcctagggttagaggtctaggtctaccttcttttagaagaggggcagtggtgagtccttgatgggagccccctgccccggagttcacttaagagcaggtgtaccttcctcccctgcgtggctccacgaagctgggaaagaaacgcacaggacgaccaccctagaaccccgggcctgtctggactgaaatcgcctctcccctcccacactgcagtgctgacaccccctctcccattaacatccaggaaggagggtgagcagactagggagggggagagggcaaacacccagcagtccttataggggggcggttggggcgggggtgcagacacaccaagggacggtttggtatccatccgctgctccctccagcgcggctcttcgcgacctcgcgatcctgtcctccgcccggccccgcagccgcccgccggtgccatatattatagcagcgccagaaatgtggtggtcgtcgccacgttagggtccgcggggtcctcctgaggcagcctggtgccaacccgcaggccccggctggggctcgtcctggccccgcccacctctgggtcggaactatggtggttctgtgagggggggcgtcctgcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcaagtaggggtgcgtgaggtggggggccgtggtgtgggggtggtccgccagggtggaccggctggcaacctgccccccggaccctgacagcctggcaacgaggagacgatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccgcgcgcagccctcgacggtttcggtaccgagagacggctgtgggggaggctcctgcgggagaaatggccaaacgggagccgtgttggggggcgcccgggaggcagttggggggcgcctgggggggccctcgtgggccagcgtcccagctctgtgcctagcccgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttagcgttggtctctctaccaagggctttactgccacccctcatttcctgtcttactttttcatctgtttgtccataggcctgctttaaggctggccagttctgcaagaaaggcaaggaggaggagactggctcacacctctggaggttggtgagaagggggagggggcaattcaggggacagttggagaaagagagcatggcaggtggctttgagaccagtgggtgcagacccacttctactctgctggatttgcacagtgccagcatcctttttatttcttgcaggggacatgagataggtgtaggttgtgttgtgactcagaaagacctgagagcagggaccaggacacaggaaaccatagatacattgaacccttgaatgggaagacagatatttgtcacaggagccagagtgcttgcctatctaccattctccattctctcctgtatgtttacttgtctgtaggacccccttctgtcagctgtggggcttgacactacttgaacaagaaaaggagggggaaactgcaccacataagtgaaggttggtatgagagtgggtatacttttgggcggggtagtggagaccagcatgggtccgggagtgcttagggtccaatctggggacttcttggcccctcccattgccgacacactttcccaccattgttggacctgtttaataggaggcagccggtccagagagactttctcaaagcccagctgtcccacctagcattcaacatcagtctcactgcatatgtctctgcatgggatgacataattggaagagactcaaagccccatttcattctctctccctagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaa

SEQ ID NO: 894 - DNA, 1686 bp, mus musculus
ttggcgatgacaacagccccacgtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcaggtaaggaacccggcggggggtccctggggttggtgtgagggagtggctccggcctgcggatgcccaccccgggggagccgtgcggagaagcaatcggtccgcgatgcagcccccgggccccgcggcgggcccgcgagccttccttgagcggagaggtgcccggcccggagggagccggcggtcctggggctacgacccttcggaaacacctgcctacgccatcagcgcaagcttttccgacacccctgccccgcacttcttggtgcagaaaatggtggtcagcttgcggggcggggcggctgaggcggggggcgagggtggcgaggagggccagggccagggccagggccagggcctcggggcggggcgggggaggggccggatggcggtagttcctagctagcgttctgctgcagcagcccccacttcccccaccccggcagtctgcaggtctgcggggctaagtgtcgcggcggcgcacctcgcgtcaagaatccggaggaggagactgcaaggataggcccaggtcggtgcgagggtcggtggtgaggcgggggccggaacgtgaggaaagcccagtctgagaccctaatccatgccttcaccctcgcccccctctaccccatgcaaccctccccttcccacacgccatcctcgtcctccattttgctgcctgcggaagcctggagatggatctacagggaaaatggtgggctttgcggaagggaggggctcggattgagggcaccccacagggcatactggcttctcaggtggaaaaaaatgaaatgttagagtataaagtcaagtccagggctctgaattttaaaaggtgcctagtagggcctctgtcctcagtgcttatcagtccaccaagaattcagcccattttctctctcttgtctcctaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcag

SEQ ID NO: 895 - DNA, 112244 bp, mus musculus
cgcaccctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaagctgtttctcttatcaaaagtttttccaaaaatactaagaactgtaccagaaagaaagaaagaaagaaagaaagaaagaaatatatactgatgtggctttttaaaaaatatatacagggcttagctcaccttcacgcacaccgagtaattcaccgggacatcaaaggtcagaatgtgctgctgactcataatgctgaagtaaaactgggtaagtttattcttatagtattttaagtccaaaacatcttaatggagaaagctcctttaagataactatgctttctatcatgtccctgccaatatcctctacttatttgagctgggttttccctgcctgcaaaaccagtcaaaatttgaaaatttgtttgggagaggaggcggggcaaaagaaagaggatgcacatacctgcttctttgaaatcatgtagataaaacaacttttgaattataatggggatttactttttggccatcgctttaccctctattagaaatagctattatatttatttcaacaattgaattgagtatttaccatgtgcaaatttcgatgccaagggaagggatttaaaaaaataaaaaaattatttcacatgacagagtcatattttctcaagaatatcaaataacttttaaattatgtaaggatgaattgcttctttggattttttcagatatgtaaagaaatgatattgatcagaatcgatgctccaataatatgcaagtcaagttcagaattataaatcaaaagactggaagtacctagctttctatgccagaattcagagttatataatttacttgaaaataaccacacatactttctgattttcttgtccttaagctcatagggaacaatatattgtaccctttaatgtgtaaaataaatatcaatagtttttagaataataccataaaaatcatgtcagtacattgtagtggcagataatcccatggatatagaggataagtcacttgcattatttttcaacagtttgtaaacatgtgtctgaacatgaccttaagatatttcccattttcttgctaaatagatagaacaagagtagagattttgttcattcattaggaacatttttcactgaacatttgtggaagaagcatgaggtagtaattgtttattcttggaataagtgaaagtagtttcaagagagtgtattatttcttttgtgtctgtctaaaagctataaagctagaaacacaattttaaaatacataaggagaggccaggtgcagtagctcatacttataatcccatcattttaggaggtcaaggcatgaggatcacttgagaccaggagttcaagaggagtctgggcaacatagcaagaccctatctctacaaaaaaaaaatgtttaattagctgggcatggtggtgcgcacctgtggtcccagctactcgagaggctgaggcaggaggatcacttgagcctaggatgttgaggttgcagtaaactatgattgtgccactgcactctagcctgggtggcagagagataccttgtctctaaacaataaatgaataaacaatgaaaatgtaaaaaatacatgaagggcatacatacttcacatttaaatacgcaggatagatagttaatcacaaggctaaacactgtgttcgcatatagagcaacactgtcatatacttgtgtcaagttgctggtcaacgcaaacatttacagcacaaaagagaaattgtatgtaaatgaaaaaccactgaaatatctgtcacaatgtccatgcactaaagttcatgtaccttcctctggaggagagaccttctactgctggattagagtttaatcagatttactttacatgtagtccctgtacagtttgttctagatttctcagattatcattattttgaagtaacacattataaaatttaatcacacatattttgcacttaattcttttacaatttgttttaaatttttaagattatagttgtttttaagcaacatagtataagaagaaagtttcagaaagcaaacctaatgacagccaaaggaactgatagaagggaaagagatggaaaaatgattatattgcagttgcaattgctcgataatcttcatattccagcctgtaaggtcatgaaagaaaactttaaattatgccattgttgaggtttcatctcgtcttggctttcatttctctttctcttgctcttttttcttttcttctattaatcagtcttctagtcttttctcctttcattttctcctctggatatgtgccatatagcaacttatggccttcctaggtaattcttggcccctaatgccagttcacagggatagtgagaatgctgggcaattatttaacctgtttctttttaaaaatctagataaaaacatggcacaacacccaatggtgatcttcacaaatattgtggacatttttttgttgttgtcgttcttgttagatcctctaaaactgccttaaactcttaggtttttctttttcctttttcttctcttcccctaaattcctgaagcttctttttagtcagttttgttcgccatcctctggattcctggaaaccattctaaattagaaaatctacttcatttttcatccctgttttattttttctggaataaataaccccagcctacttcagccttttttctgtttctgaggataccataccaaatattttcttataatgtatcccacagatgaatagaagactgaacttttataatctaagctaagatgtagataccacagtaaatacctgcatctgattcaaaaggtctatgtaggaatttaaactaaattctagcagaaaaactcatttttatttatcagtgtgatagagccttctcatatcatgtgtgaggcttcctgatcaactgctaataagttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatctgcaaaataattatttactgagagtctattatgttcggtgctgttaggagctacgaagactatggaagcatgttcttcaagtggctttttataaataatgctttataattgtatactttttgcagtcttccaaggactttcacctgtattcgttatttatttttagtttttagcaccatgtaactgaaagaagtcttaagcatagactatcacaactcaagctaagaaatctatcaactagggttctaaaaatccagttaacctccgaggccgcagatcacctgaggtcaggagttcgagaccaacctggccaacatggcgaaatgctgtctctactaaaaatacaaaaaattagccaggcgtggtggcaggcacctataatcctagctactcgggaggctgaggcaagagaatcgcttgaacccaggaggcagaggttgcagtgagccgagattacaccatcgcactccagcctgggcgacagagtgagactctgtctcaaggaagaaaaaaaaagagaattcagtaaacctgtttaggagtcatttagccagccgttgtatctctagccctgtgccctttccacactctgaagaaaaaaagtactaaacagttggtagtgaagagaattttctagagtctttttctagtcttagtttagtatattccaggaactgctgaagtacacacacacacacacacacacacacacacacacacacacacatatcagtcctatgtaagtgtatgctattgttatcaccattttacttagagtggaattaaggcacagggagttaaaacatttgcccaagatgatacaactggtgggtctatgtaataaaatgtctttatggcaagtttcttttggtatttcaggtaaaacgataatatcaatgcatccaagatgaactttccttgagcttaactccattccctatcaacctgttgtgtagtgaggtactggctggtcagtagctcagattatgtcttcctataatgtcactctataataaagcttcattatgggaaacccataaaagagctctggcattgacatccacacccccagctaaacattgttttgagattctaaatactaccaatttcctatttttaagtgacttttttgtcatctttgtctttgcagagtgatgtgtggtctgtgggaattactgccattgaaatggctgaaggagcccctcgtgagtaaaaaatgtttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaatatttcctaaagtctaatatcttaactgggaggtctaaatgaccagttttcattaagaggtagctagccaactataaataagtaatatcctctatagtattttctgatgatattactgtactgccattaatgggcatgttcagttgtttccccagtaatgggatgaactgatggcaactatttgtgaagtttcttgtgttgcttatataggcagtcagttatatgcagccctgttgattagtacattaaaccaaacacacacagacctagagcagaagacttgttttcccagggcacttacatgccagctaaacttgggaatccttctctctgaagcttgttgatcttgtacctgaaactcttgcttattattagtttttattgctttccctggtagaagtggtgactgtgatttgattgttaacattctgcattggaattcaatttaaccctttccatggattcagtttttatggccacatctgttttcatgggtcattttacaagattagttagtcctggtgcttttaacatcctatttttggatcattatattcattcctctgtagttaaaactgcatatagtcaaatgaaaaatacagagtatgactgctgtgggccgatcaatctagtcttgcagactacatatatcacattaaccatttaatcatcatatctgcacttgagtttttaccaggtacatacagttaactcattgaaacttctactgtaatttagatggaatatgctattgactcttgcttctttttctgaggtctaaatggcctcactttataacgtatgttgccaaactgcaggatatttggcaattgagaagacaataatacctaaaggcaactctctccaaatatgattttcagagaggcatgtgggtggtggtgggaagaggtctgacaggactgagaacacttttttttcctctctttgactcattttttaggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgcagttacacctggcaaatgttcatatttatgaagaccttgaaagcatccaataaagttttgtgatatgccaattttaagtaactaactaaataaaataaataaaagataaaaggtaacaaaatgtatatcttgcttttttttcagctggtattttgactctacaagagataaatggatttgtaattaaccatttattcactgctaattttgaagtagtatttgtgcaccatacaaagcttgttttatgtactaaactccaaatataaaatataattaaaggaactgatttatacaaataaacataaacttctgtctattaataaaagtgaacttctattaaaaatggcaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcaggtgcgttccacaaattgcatatataatttgatgatagcaattcacataaggccgttgattccatactgttgcctttggttcagaaagacttaattctttctgatacaacaaataacaaatctctgtttttaagagatattgagtgaaaatgtgagaattctttattactacccaaagactccttaatatctggcaagtgaagatcaagtagatatcatatttcattaataattgaatacattagtaatacaaatgttacctgcagaatatttcagacatcaagggaatgatttcagaaaggtttactgaaggtatcttcattgcagaaaatgtccatcttttaaagtaaaaacaatgcccctgaatggctccattccactaaaaattctaattgtatgccaatcatttgtgtgtttattttagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagtaagaatttttgatatttttactctgagtcaaaaatgaagagaaaatgtgatagctcatgcggatgttttttctcagtaaaaccaaatgaaataaatattccttgtgttctacagaagatatactaaataatttgtacttcaaataaattttcatgaaatttctagataattgtaactaaatatgataaaaatatttttcagtatctctactgaaatatagctttaattattagttttctgtctattattctttaaccaataaagtgtcaacgaatgcacattaaaaattactattttggatctttaaaaattactttcatagcttaaaatttcaaagataactcatcaaaaataagcacaaaacaaaatttgcttttgttactctaacctttaagttagtttattctttcttccaatagaatgccaaactatactatttgagtgaattacactcatttttgtactacaggatgtttaaatcaaggttaaaatgagaaggcaaagcagtttccaaaatatttggtatatggttaccatatttatgacttgtttcactaatttgctgcccgttttacataattaatcaattatgtggcctcacagaacgtgaaacaatttacaaattattctccgtgttagaagaccaacaggttcgtatgcccactgcatagtaacagaccaattacacatgcatcaagaatgcagcagaagagtttaatgatcagcagggcatggagtgaggaggtggggaggagaccctcaaatccatctcctggaggagttctgggatggggtttttaaggggattgtagagggtgaggtgctggataattggagttgttgattggtcagggtaaggttgatggtccttgaaatcatcaggatgtggaaactgcattttttgatgagtcagcctcttgtggggtccttcagaccagttggcgtcagtggggtccttcagaccagttgattgacaatagtttcactggtatgcaagacctgaagaaatatctcaaaggaaaaacaacatttcataatgttcaagttgttatctacagagcagttaaggggaatgatgatgttgcaacaaggtctacgtgagtctaggaaaataggcaacaaacatctattgaggaaggaggtcagagagcaagctgacctaaagattaatgctaaacgtgctgcaagcttggtatatttttgtttcttcccctctcttcttctgtgattaattttataagttaataagggtggtttcatctgtacccttttgaaatgtggaatacagtgtgttaaactccattttatctaagaacagtcactaaaacgtaattgtttcaaaaatcctttaataaaaagtgaatataattttactggagttattgaatttaatctggtggattctaaactgataatgaagaattatgggcttgataacaaattaatgaggttagataaggttaggggagcagttgttttctaatactccccacatccatttgtgtaaaaggaatcattgtgatgatcctaacttatacccttttatccacatctatttacccaataataatcattgtaataattacaaatgaattttatctgagtatctagataaggaattctttgagtttgtgcacattgagccaattaaacaaatgctaatttgttgacatgtttaacatgagaaaaggtaggagcagcaagagaagcaaggcccaaaagggaaaatggatgtctagttctcagagaaaaagggaactataaggagcaagaaactagatggagaaaagggaggtttaagtctagaatggtgacatttggcaaaaactagctcatctaaaatgctaatgattattctcgatgaaccctagtaatcaattagatctaatgggttttgcatttatgaataagacttttattgatctctgaaagattcagtgataccagcatggcacacacttattgtcatttattgttttaaacatatatgtggaaagccattctaaaatttttaaaagtcaataaataatagttaccaatctcatgactctaggatattgtacaagcatttatatctttatatgtggtcgttgaagaaaatataaaggaaaagaaaattattgataatatagtcaaagtcacagatcttcatgatacctgaaattttattagagttgagagacataggtgggtgctttaagtcaccagcaggaaacaaaaaatgcatttttattaatctttcagttgaagagataatattgattggattaaaggggaaaacagtttcctaaagtcctagatctcaattagggagaaatatttgcaccactgtattacagatcttccattgctcaggaagaccaaactttggttataatagcttgctaaatgtgacagttagtttggtgttatgagtcaatcaagttttaggccagagattcttaacctggaccctgtagatgaacttcaggaggtcagcaatccaccagaaaatatatgtaataggtatgtctatatgcaattttctgtggacagtctatagcatttctcagattctgaaagggatccagaaccaaacactattagaaactactggtttaaatcatttttaatatttggatattattcttttaaattgtgtattattttaaattatatattatataatacatataaacaattcagcattaagatgatgaagttgttcctatcacttgcattttaacaacaattaaaacaattactttcctttttgtttcaaaggacaaagaagatgaatcatcagacaatgatgaagtatttcattcgattcaggctgaagtccagatagagccattgaagccatacatttcaaatcctaaaaaaattgaggtaaatttttcaatatgagttgttgtgacattagtaagaacccagaacagtggttcttaaactttttggtctcagtgtccctttatactcttaaacattgaggacctcaaaaagctttcattttttacatgggttgtatcatttgatatttaatttattaaaagttaaaactgaaaaacatttaaaatattagttcatttaaaaggaatgaaactattacatgttaacataagaaacacatttttaatgaaaaaactgtattttcccaaaacaaaattttagagagattgacattgttttacttttttgtaagtctcttaaatctatcttgcttaatgaaaaacagctggattctcacatctgcttctgcattcaatctgttgccatgtgttgttttggttgaagtatacgaataaaagctggcttctcacatataggtagtgggaaagagtcaattttcatagattgcttagataattgagtaaattattgaataatgtaccaaaactagagaagtggaatctaaaaccatatcaatgaaatgttgtatattcagttaataataaaactcattgatctatcttatgctatgaatagatgttttgcttatgcatgatttttaacttcatgcattgatcagttggaaaatactggttcactttgtatatagatcttcccagacatttacatgtttcattatacaatatcaaaaaacagcatttgttaatgttaccatcaagttcatcataaaagttactgagtgttgttaaattgtcaagtgcttggtgggagatatgtttgaaaattctaattttcctttgcaagctcaaattttatcattgctaaattgtggcatcattttttccccttaaattgacaggtttactttattcattaaaaataaaatgtctaccaaatacccagagtttaaataatcatagtttgtcagtctttctttaagcaaaaatattgtacattaaaaattctggcagtttcgttttgtaacacaaacacaaatatttttccttgattagctctggtctggaatgcagtttgtgacagggtctgggacatttaatctatgttttgttttgttttgttttacaattataagaataattaagttagtcctagtgtccattttgacttctgttttcatgagtatattaatagtatcctatttagaacatatattggtgaggccggagttgtaggttttcttgtctagaaaaggtagcatcatcatcatagccagtattcctaatagccagccatctaaaacaatctttttgtagattgttttgaacaatcaagtagattaggtgagtgtgtgaagaactcaaactcttgccttattgatggtgggtcaggagcctcattgttgctcctaatcagcacaagatgttacacaggagtctactatgaagtcttttatggacaactctcatttttaagtacaattcccctaatactaacagtcctctgaagttaataacaaagagtattgttttataagtactaaccactggcagaaggtacataagccagactgtattatataattagaagaggcaatatgtctttttctttgccttattaaatgactttactcaaactcacaggtaataattattaccttaaacctgacactttaagcaggaaatgtaatgagctgtgtctgatttgaaatacatcattatcttagtatatgctattcttactaatcattttcttctccccagttttgaaattaaatacagccaatttatattaggaattatattttttatttttggccgttacctattttgagtaatttttgcctccagtagtgacaataaacttcctaagatcagcttcataagccaaaagtccccgactgggtcatatgataccaattatatgaaatgaaagtggaaaaaaataggcagatacttaccctcacctacttgtctctcggagtgtagagagagccttgataagccacttcataaagaaaaaatagtttactaaggctactctagtttctagaaagtatagaatgagtttatcagcatgcatatgctagattaaaaaagtaacactcttaaatttcctttttaaagaatctagtatgactgccttattgcatgtcagaatgacctatgttttgggcagctaaaacttctttgagtagaaacctggtgatacaagtcttagtgaggcaaggcaacattccctggccctgtctaccaatgttggcagaaagtaaaattcccccattggtggaagctggcttattatatgcaccctttcttgagtatttggctatattcaatgattgtatgattagtaaaatgcaaattaatctatttagagttgaaacagtacttggaacactaattatgatagtacagtcaaattgtaaagcagaaaaacatactttcttactttcttaaagatgggacacttttgactagagagattttaatgaaatgtatgtatgtgtgtgtgacaacttttgaaaatctagggttagcttaaaaggatgagtgtataagaattagaacttaaattctgagtaagaagtttaaacttgatataaaaagcaatgtgataacatggaaagaacattaaattagaagttgggagacctgcattctgattttagacgttcctttcacttgacataaaattcttagaaaagtcattttccctctttaggctacagattcctcaacaataaattaagattttgattatatgagctccagaatctgttcctatactaaagatcaaatataccatcagaaattatggttaagcaagtctaatgttgtaagtcattatgaaatagaatctgtttattaaaatcatattttataagttagattttaggaaaatatatatgaagacaggcattttcccacaaattaagagctcagtacaatttatgatcaagaattctactgaagtattgcattgtgtctttaaggttcaagagagatctccttctgtgcctaacaaccaggatcatgcacatcatgtcaagttctcttcaaggtatgtgtctttgatttctatattaaaattattcataattatcaaatggaaaattaaaaattatttcattgataatacactttgtgaagtcaactaaaatatccgtgacaacatcatcaccattgactttattggcccacattgaaaaccttaactgcaatgatccattacctatatctttcatatttggtcatactgcagtctctgtgatatttagtttgctaaatagatggcaaggttcacaattttaaaaagaaacaataataacaaatactttgacagtattcaattagtagtcgatgataaaaagacatgaaatttcaagtgaattttcacacatgtgctgcatgataaaacacacacaccaattgtctttaacttcagaagctaatgccacagaatgggtaagcctaaaaatgtcctatagtcaaaatcaaatctaaaactcaatattatataaataaaatatcatatataatattgataccagtcactgtattttttaatctttgtaatattggtgatcttcaataattttcaaagatcacgttccatatgtcagatattgtgtgcattctgttatatttgaaaactaaattttaaggtagatttttttaagaaaatctcaccccctccagccccaactcacaatagagagaacttagcctatattgattcatttagtcagtaaatatttattgaacactcactatattcaagatattggacagtatggccagatggcgtacagttaatgttatgtagtatatattttcttgcttcattactttaaaaaacccatacaattatgtcttcagatttaactggagtgcagaaatcttgaaaaattgtaaagcaagactgcgaactttctttttctctgcactcaatgaatggattgtcatggtcgaactgacctcaaaggaaagaaaccagtttagttttgagtagttggttttggtatcatggaacatgactttaataaaatccaatatataaaatccatacttggtgttaaactcagagtaattgttcactttacaaaaggattttgaatttatgaataacaaatacgttgcctttaaatatagttaaatttaaaaagttaacttaaatgaaactcaaatctttccggaaatttggggccatggaaaaaagtttgtctattccagacctaaatcaataaccaaagtccttcccatatagaaataccaaaataactgtaaaatttagcagcattagtccaaagaaactctctaaatattctttaaatttgaatagtaagaacgaaagtgctctatttttctgtcagtgtagctatctaaatccggaatgggacgttaaaaacattaatttcaagcatttaaaatctggataataacaatagaatatatgacataacagtaacttgtttattatgttaaaatactcacatacactataaggttatgtttattgctgtgttactcaggtaaaatattgtctgaatgttagctttaaaagcttatagaaatttttagaaattaatatatatataaaggaaacatatactctatgaaaacatatttttcttattttggaaatcgttactctattctagacaaaatagcaagtttgggggagaatggaaactggaaattattactcaagttatacttctttttcagtttgatatgtacccatatatttaaacaaaactttgtgttggactttatgttgagttgtacattccctttatgaatgttaggacatggcacatgcttttctgtcttttcattagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtggtcagtggtggcctttgagaaatggaaaataatttttctgaattttcttctttttgttgggtagtagttaggaatgtgtctaagaaggcggggggagtcagctttattaggtttctataccacgtaagaaaagtatggtaaagaaacttgagagagacctctccagcaggctaaaatttataggtagcaattagaatattgtatggaggagttgtgagtgtgtgtttcatttatcagttggttacttcacctctccaaaataggacaatatctgataaatatccctaaatgttacagagtgatggttttactcaaaatacatgaacaattaatctatcaaatcatagaaaataacttcaaaagttgtgatgtgaatttcaaaaaagtattttaagatgtgcttttgagagagtttaaatgaattatagatttatgaaatattaggataaacaaagccaaaagttgtgccatggatcatgcaatctggcattatccagttttaagcaatccaggtaagttaagcaagggaaaaatggctgattgagttgctgatatgtaaaaatatagtatactgattttattaaaatgttaataataaaaatgatacagatgtacttcactttttgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaaaaaaaaaaaaaaaaaaagcacaagtacaacagtgtcagaagatggggacacaaattttagcatgtgttcagtgtaatgttctcaaaggacagcagtatttgcaaatatatgtcttttggagttggagtatctatactttggctatgtataccaagactgaaaataagagggacaatagtatttatcttgaaaatctaagcacacaaaaacattaaacagggacctgagttttctcttagtgaagctttttctaagtacactcacccagacctgaattttgagcctgttaaatattctcaccagattttaatcacaggggttatttaccataccacaactcaatattaaaacctaatctccaaaccagatacatttgtattttaaatggaaatatttacactatagaattgagctgttcaatgtggtagcaactagcctcatgtagctattaaaataaaaagtaaaatgaaaattaaataaaatttaaaagtcactttctcaggcacactggccacatttcaaatgctcagtagtcatgggtgactaatgaccactgttaatggacagttcagatacagaagatttctatcactgcagaaagttttgttgtacattgctgctataaaaaggttcccagctttatagaaacgggtgttatctcttttcagtagttcactcctcaactgtattgaactacatctggatatatcattgggtggaaatatgtgggggttaagattgaagaatgtaaatttgtttgagttcattgtagattctggatattagccctttgtcagatgagtaggttgcgaaaattttctcccattttgtaggttgcctattcgctctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgaaaggaagggatccagtttcagctttctacatatggctagccagttttcccagcaccatttattaaatagggaatcctttccccattgcttgtttttctcaggtttgtcaaagatcagatagttgtagacatgcggcgttatttctgagggctctgttctgttccattgatctatatctctgttttggtaccagtaccatgctgttttggttactgtagccttgtaatatagtttgaagtgaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaagttggatttacaagataaaaacaaacaaccccatcaaaaagtgggcgaaggacatgaacagacacttctcaaaagaagacatttatgcagccaaaaaacacatgaaaaaatgctcatcgtcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttttagggacgtggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggagtggggaggggtagcattgggagatatacctaatactagatgacgagttagtgggtgcagtgcaccagcatggcacatgtatacatatgtaactaacctgcacaatgtgcacatgtaccctaaaacttaaagtataattaaaaaaaaaaaagattgaagaatgaactctcctcttgagggttttggctagtctatcatcttctaataaatacactgtcgggcttttttttctactggtcagtatgtgaggccagtggtactcccagtccttcctactcttgatacatttttttaaatgtatctacctggctatcagttggactatgtatcttcttacatagatagagatatttggtaagtgtacacttaatattgaaaacagagcagccatgtaagtctacagatggaagaaaacttgaacccctgctaatacccctgaaaagagaatttaagatcctggccccatgagaattttcaggtgatacttcctgaatggaatcataaaaatgaccaagaaaaaaaaaaagaaaaaaaaccaagggatttaactgatacactatacatatgaaggcaatggctgtaatcaccattgttactaatgtgtttttggcattccatagaatcttcttctgaggaagaaagtcctgtgactggaaggaggtctcagtcatcaccaccttattctactattgatcagaagttgctggttgacatccatgtaagtttccatcttaacacattaatgtctattattttttattttccatttattttgacttacacattctcatattcacttgagggaaaggttaaagagtttagttttttaattaacattttaaggatagattctcattgctttgtgaatacatagaacacaaaatctagaaattaaaattgaaatgggaaaacatttaatcaatcagagaatattttattttcacattcttgtgtcagttagaacatgtctgggagagtagtgataacaagctgtttgtaaaacctaatctcagattgaggggtacaggttagatgtccaacttttaatagcattccttgagtgatgaggcaatgcataaatataaaacatttagtaaaaaacagagtgtcctctgactgcataaataaaaagtcttccagctctttgtgaacatgtttaaattgttctaatgcagattttaaattgtcctaatgcaatgtgctttcagattattctatttcaattttgaattacctctatgctaccgtacacacatcccttccagattgcccaaaagttgttaaatgatacataccatacttaaaagatggatttagattaatttgcactttggaagtgtttgagatactttaagacaacccatggcacgtaaaacctgagctggtaaattaacatatcaatttcaagagctgtgtgttaatcccaatgtcaggggataaaacaaaagggaaaagttaccatttttaaggagcatcaaatctcctgttctctccagcatcaaaagcaagtgtccattcctgagctgacaagtatgggtattttttttaagtgagtaaattttgccctatgtgatccagaaaggccactaataatcacagtctgatgtttgggttttgacatctcatcctcactaaaattttggctccatctaatgagtgaacatccttgtttcagtttaaaatatatttcaaaatgttgtcagcttggaaactttccaatctagaagaaaatgaaagctactagaggctacattaacctttcttgtgcacacaggttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaaggttggtttttttgaattacttatactctccatgttttatgactgcagagctatttgcatttttggtttattttcaaaatttattaccaagagagtgacctaatttcacttgcattttagtaaatagtttgattgtcaataatgtattttaaattgttctaatgcagaacatctaattttgtgtcatttgtgtattttaaaataagcattcaagtatttattagtttctttataactggaattgtctagatgcttatgttaaaattactgccactgaatcatcctactctataaaactatactgagtatgagaaaggacaacaaagaaagtgtgtaacttaacaagcataagatgaagtcttggtatttgcaaacatagctattcatttctcaaacttttgtgatatcactatatatatatatatatatatatatatatatatatgtgaaatttaagatgatctttatctgtttaattggtggagaaattaccaagagctcttttaattttttccaaccaaaaaagtctatcaagaattccattatgaaataaatttacttttagaattaccacaggcacgtatgtttaattttgtttcctatgcaaaaagagagcattggcacattttgttaagcttagtatttttagcaattaattaaataacttagttccacaagacatgaggtatgtattgctgaacttccttggtgggagtagtagaccaatggagttctatagcaaagcagtcagtacacatgttagaaaatcaaggcacatgttgaaatgaacacaaactagatatactgcaagaagaattaatcatgttgtggttgagctaaaacataggcttaatcattcatgtgtctgtgaagttgctaatgcatgaaatagtatatatttaagaaaaaaactacatattcttgctgttaacctaatacacgcacctaacaaagaatacaagttctcttccctctgccatccaaatgcatctgagaaattggtggtggctatggctttaatcattacataagactgagaagacataggggcatttttatgttctttatcataccagtagtgttcacatagaacaaagacaagcctgggcatggtagatatgtataagacacatcctaattctgttgtacttgctaactttcaaatgtgtttttattgcgtgactttctttcattaattggagcttgttgtcagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggtaatgcaccatttgaaaagcagattgaactcctctcattgcgaatgtgtttcttcatgggacatgtagcatttctagccattccaaatagattttcatcatataccccaaggccttaaacatttttaattataggtttgtaggtggatccttattacctctaatttgggtggttcctatttacttccaaagacaaaaatctcttatttgtttgcctttattactcagatcacatatttgaggtagtgtctcttgacacacactttttaaaaatattttaaaaaattaattgacacctaataattgtatatatttatggggtacagagtgatattttaatatatacaatttgtaatgatgacatcagggtatttagcatgtctatcacctcaaacattcatcattttttttgtgtgttgggaacaatcaatatcctctctcctagctatttgaaaatatgtaatgaattattgttaattatagttaccctatagtgctatagaatattagaacttatatctcctatctagtcatgcatttggatcctttaaccagcctttctctatcactctcccgtactcctcttcccagcctctagaaacgactatttactctctagttacttgagaccaattttttagcatttgcatatgagtaagaacatgtggtttttatctttctgttcctggtttatttcacttaacattgagtccaggttcatccatgttgctgcaaatcacaagatttcattcttttttatggctaaatagcatttatttctgtatatatgtcatgttttctttatcaattcatctcttgatggatgcttaggctgatgccttattttggctattgtgattagtactgcagtaaatatggaggtgctgatagctctttgatacactgatttcctctttttttgagatatgtacctagtagtggaattattggatcatatggtagttctatttgtagttttataaggaaccacaataccattctccattgtgggtgtagtagtttacattcccaccaacggtatataaaagttcccttttctccacatcttcaccaacattaattttttatgttttgataataaccattctaactaggatgagataatatctcattgtggttctgatttgcattttcccgatgattaattatgttgaaattttttttcatctatctgttggttatttctaagtcttttgagaaatgtctattcaaatcatttgtccattttgtttattatactttaagttctagggtacatgtgcacaacgtgcaggtttgttacatatgtatacatgttggattatttgcttttttctgttgagttgtttgagtttcttacattcaggattttaatcccttgttggacgaagagtttgcagatattttctctcattcttcaggttgtttcttcactttgttgatcatttccttttctgtgcagaagatttttagtgtgatataattctatttgtctatttttgcttttgttgcctgtgctttggtcctattcttttttcccaaaccaatgtccacaagcattttcttatattttctagtagttttatggtttcagatcttacatttaagtctctaatctattttgagttgatttttttataaggtgagaaataggggtctaatttcagtcttttgcatatggatatttagttctcccagcaccatttattgaagacattgttctttccccagtgaatattcttgatgcctttatcaaaaatcaaccacaatgagataaatgaatatgtggatctatttatgggtcctttataccgttccattggtatgtgtgtctgttttttggttgctgtagttttgtagtatattttgaaatctgatattgtgatgcctctagtattattctttttcctcaggattgctttggctattctaggtcttttttggttccatgcaaattttaggatttttttcctatttctgtgaagaatgtcattggtattttcataaggattgcatagaatctggatattgcttgggatagtagggtcattttagcaatattaattcttctagtccatgagcatatgttgcctctccttttgtgtgtgtgtccttttcagtttccttcatcaatgttttatagtttttcttgtagagatctttcacctcattggttaaatttatttccaagtattttattttgtagctactgtatatgggattgtttttgtgatttctttctcagctaggttattgttggtatgtacaaatgttacagatttttctatgctgattttgtatcttgcaactttactgaatttgttcatcaattctaagaattttttggtagtgtcaaaggatattctatttataagatcatgtcatctgcaaacagacactctttgacttcctcttttccaatttggatgtcttctattgccttctcttgccaaattgctctgattaggacttccagaactaagttgaataagagtggtgaaagtggatatttttgtcttattccagttcttagaggaaagaatttcagcttctctcattcagtgtgatgttagctgtgggtttttcatatatggtttttattgttttgaggtatgttacttccatacccaaactgtggagagtttttatcacgagggaatgtagaattttatcaaatgctttttttggtatcttttcacatgatcatataatttttgtctttgattccattgatgtgatgtatcatgtttattgatttgcatatgttgaatctcccatgtatccctgggataaatcacactcaatcatggtgtataatatttttgatatggtattggattcagtttgctagtattttgttgattatttttgcatctatcttcatcagagatcttggcttgtagtttttgtttgtttgtttgttgtaactgttgtgtccttatctggttttgagatcagagtcatactgacctcacagaatgagtttggaagaattcccttcccttcaacttttttggaatagtttgagaatcgacattagttcctctttaaatctttggtagaatgcagcactgatgccatagggtactggacttttctttgttgggagactttttattgctgattcaatcgcattattcattattggtttgtttaggctttctatttcttcttggtacaatcttgctaggttgtatgtgtccaggaatttctccatttcctctagattttctaatatgttgctgtgtagtttttcataatagtctcttatgattctttgtatttctgtggtatcagttgtgatgtctgcttttttgtttctgattttatttgggtcttttatactttcttgttagttaatctagctaacggtttgtccattttgtttatcttttcaaaaagccaaatgttcatgttgtatttcttctgtattgtttttgagtctcaatttcatttacttttgctctgatttttattatctctttatttctattaatttggggtttggtttgttcttgcttttctagttcattgaggtgcatcattagattgttattcaaaatctttctacttttttaatgtagtcatttattgctataaacttgtctcttactactgcttttgctgtctcctataagttttggtgtgctgtgtttctatattcatttgcttcaaataatttcttaatttccttcttatttattggctaattgatgttcaggagcatatatttttaatttccatatattgttacagttttgaatgtttctctggttattgatttctagtttattctattttggtcataaaggatactcaataataatgttgatttagaaaaatgttttgagacttgttttgtgtcccaacatatggtcagtcttagagaatgtttcatgtgctgatgaaaataatgcatattctgcagctgttgggtgaaatgttctataaatgtctgttaggttcatttggtctatgctgcagtttaaatccaatgtttctttgttgattttctgtgtagatgatctgtccaatgcagagagtgaggtgttgaaattctcaactattattatattgtagtttatctctccctttagatgcaataatatttgctttttatatctgggtactctagtgtttggtccataagtatttataattattatatcctcttgctgaactgatcctattatcataatataatgtccgtgtttttctcttttttacattctttgacttttaacacctgttttatctgatataagtgtagctattcacgcttgcttttgatttctgtttacatggaatatctttttccatttcttcattttcaatcagtgtgtgtcattacaggtaaggtgaatttcttataggcaacatataattgggtatttttatttttttatttttattttttttactttttaactgttctactagtctatatgtttaattacagaattttgtctgtttactgtcaagtttattattgatatgtgaacacttactcctgtcatttcgttaattgtttctggttttgtgtatccttttttttctattctcttattgttaatctatgttgttaggtaatcttttgtagtaataaggtttgattcctttctatttcacctttctatacctgctttacaagttttataatttcatgttttcatgatagttgttattgtgtttttcctttcagatgtaggactcccttaagcatttcttgtaagacctctctagtggtgatgaattcctctgctttttgcttatctggaagaggctttatttctccatttctgaaggattgctttcctggtgatactattttgggctatcaggttttttccagcactttgaatatatcatcctattctctcctggcttgtaaggtttctgttcagaaatctgctgttagtccaatgaggatttccttatatgtgataagactctccttttgctgtttttagtattctctctttgtcactgacttctgacagtttcactgtgattttctttgggaggacctttttgagttgaatatatttgataacctttgagcttcctgaaactagatgttcatatctctctcccaagacttgggaatttttcagcttttattttattaaataagttttctacatcttttcatccttctggaacccccataattcaaaaatacatcctcttaatgttgtcccataagttctataggctctctttattctttttttttctcttttttcttttctgcctgaatcattttaaaagacatgtcttcaagttcagaaattctttattctgcttggtctagtcagctattgaagctctgtattgtattttttaatattattcattgaattctttatcttcaatatttctgtttggttcttttttaatgatacctattcctttgttgaatttctcattcagatcatgattttttaaaatttcattgatttgtctatctgtattctcttgtatcttgctgaatctccttaagatcattattattaattccttttctggcacttcactttttcttttctgttgggtctgctactggaaaattattatgttcctttgaaggtatcatgtttccttatttgttaatgtttcttgtgtccttgtgttgatatctgtccatctgatggagcaattgcttcttataatgttatggagtggctttcataaggaaagacttagtccatagatgggtcctggggtgttggttgggttgggtgcattgactttggttctgggtggatgcagcagtgtggtctctatgctgtaatatacattagcaacgtttgctagtacctcactggcccaggctgcaaaagtttgtggcagaggtggcacacctttgccaggggtgggcttgccaggctgtttctcagtccagaggcaaaagtgcacatgcggtgggttgggtggctcaggaatttgccctccagtgttgagctatcagactacttctctgggcaagagtgtggtcacacagggtgggaaagctagcttggggtctggcttactgggatcagtgctgctgagctgtttctctggccagggttgcaagtgcacagcagttaagccagcctagagttggcttcgccaatgtgcagtactggagttatggctgacctttcctgggcccaagatctgagcagtcagggtcacagcatttcagccatcagttggggcttggtgaaatgacagtggagctgcaagactggagaggcacagtgtttactggcccccagaacatagtgtatttcagcagtgcctctagattcaagatggcaccaggctgcagcagcttaggtcatgggttggtgggaaatgcacaacttttgctccttatctggagcaatgcagacacatgaatttcaggcaccttcccaaactgaactcagggcttgtgaggactatgagattctcctgtagtaagtactacagttgtctgtggtggcaattggggctgatgagagtcttctgcttaccttttcccaataaggagaatttattccgggctctgagctgatcatggtaggggagatggggcagcagaagcagagtacctcacttccctctctttgctgccattttgagattccatgctacacagtgacctcaccaccccatcactgcactccaacactctccctcagacacaccagttgaactctgtttattcattctctttgtccttttttgtgagggggacaagcaccaggtgccaccaataagctatcttactgacatcactccaactggaaccgattatttttttctgagtttttttttattgtagtaaaatatgcatatcataaaacttaccatttcaaccatttttaagtgtacaaaccagttggatttattacattcagaatgttgtggggttgtcaccactatccattttcagaacttattttttttaccatcccaaacaaactaaacaattaagtcttgtttcccccctcctctaacccctgataacctctattctacttttttttcttggtgacttatataagtggaatcatacaatatttgtccttttgtgtctggcttatttcactttttaggttttcagagtttatccacattgcagcatgtatcagaatttcattccttttcaagggtgaataatgttttatcttatgcattcaccacattttgtttatccatttatctactgatggaaacttgggttgtttccaccttttggttattgtgaaaagcgctgctgtgaacattgatgtacaagtatctgtttgagtccctgctttcaggtttttggggggtatatagctaggagaggcattgctatatcatgtaatcaggctatgcttaacttcttgagcaactgataacataaaattttaattcaagaaatatactgtgtttagacaatgattttgtcattcacaaaacatttattgactttataaataggtttaaaatattcaagtagttcacagatgctacatcaatagaaattatcacacataatattttctgaaccatgtggtatttgaactcattcttgagaaatggggagtatctggatatctgaaaacacaggtggaactccagacagaaaaaagattatgccagtctactcccctagcctattttcttgtcacacaaactggctttggagatgccatgctctttcatgaatcagcgctcctgtgcaagctgtttcctctggaaggctgccccctcacctcttctctgcttggtaaattagtaatccttcatgggccaaattaagtatcaactttgacttcccaaggcagagttatatatcccttcctttctacttacaaaccttttgtccatagttccaatttagtacttatggtattattgttagttattttatttttttgctttcatactatattgtgaactcttaaaggaaataattatgtctaatccttccatgattatttgtctaccaactcacccaacttcagtgtctaaccaaggacatggcatatgataggcacacagtaattatggaataaatcaataaagtttgaaaagaaagaaaaaaaggaaggaaggaaatttcctggatggtttctaatgggaaagcagtgtcagtgggaaaatatctatgtctgtctatctatctatctatctatctatctatctatctatctatctatctatcttaattaaagacattaaaacaggatgtcccaacataagtttcatagcaaccctggttatatccagttatctcaaggaatgttttggaaatttatagaggaagtggatcttcctttcattttaatttaaaaaggacgtgatgtcataccatgtttttgtggttgaaaaggtcataaaaaccagtcttttgcagaatagcacagctctctcagtgccaagaatcactgtttagacacaaagatgagcttatcaacagaataacttaccaacaatagttgacatattttcccacaggacagggcataccacataaattgtcacatttcgtggcttttatccttgagtatcttctttgtaagttaatggaagccagctacattttcagtgatgcatgtttacgctcttggatttgtgttggttgatttgccttcattttctttatcatttgaaaattatttatgcaggtttttcatgctttcagttttgtgaagataccttaaagcagtagaacagacacccccacactgtgctttatattttttcaagaggctgtttggcatagcatagctggatgtatgctttggaatcagacagactttggcttcaaattctgcttcccctacttactagtactatgactgaatacattatttactgtctctaaattttaaatttgtataagtaaattggagataattatacttacttgttgggctatggtaaggattcacaaagatatctaaatatcatgcttagcacagtagctgatacatggtaaaaattccacaaatgttaggtctcaaattgtacagttgggaacctatagctccttgcttttctcctgtaccatcagtcatctcaataataggttagttttctccttctgatgacattgttgagtttttctagtaaatgtggattttataagaatgtagatgttatagatcttgcattgtgtttttcaaacgacccctcactaggcatatttctcccactgttaacctactaatgaaataaaaattggtttttggacttcttttaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtgagtgtgttcaatgtaatctctaaatgctactatctgttcacttattaaatagtgtttaaccactgcttcatgatctgttaggaatcaaattattctcacattcacttgaaataaattcagattgatatatgcttttaaaacatctactctttactgaatctttatggtacctaaatttgagctacaattgagaaattgagtcccttatatggatttatgtgtgttttctaatcacaataacttaaaatatattcgtgttcaacaatgtattttagccatcacgatttgtgttatctgatggtttcagagttactgaaact

SEQ ID NO: 896 - DNA, 136087 bp, mus musculus
cgcaccctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaagctgtttctcttatcaaaagtttttccaaaaatactaagaactgtaccagaaagaaagaaagaaagaaagaaagaaagaaatatatactgatgtggctttttaaaaaatatatacagggcttagctcaccttcacgcacaccgagtaattcaccgggacatcaaaggtcagaatgtgctgctgactcataatgctgaagtaaaactgggtaagtttattcttatagtattttaagtccaaaacatcttaatggagaaagctcctttaagataactatgctttctatcatgtccctgccaatatcctctacttatttgagctgggttttccctgcctgcaaaaccagtcaaaatttgaaaatttgtttgggagaggaggcggggcaaaagaaagaggatgcacatacctgcttctttgaaatcatgtagataaaacaacttttgaattataatggggatttactttttggccatcgctttaccctctattagaaatagctattatatttatttcaacaattgaattgagtatttaccatgtgcaaatttcgatgccaagggaagggatttaaaaaaataaaaaaattatttcacatgacagagtcatattttctcaagaatatcaaataacttttaaattatgtaaggatgaattgcttctttggattttttcagatatgtaaagaaatgatattgatcagaatcgatgctccaataatatgcaagtcaagttcagaattataaatcaaaagactggaagtacctagctttctatgccagaattcagagttatataatttacttgaaaataaccacacatactttctgattttcttgtccttaagctcatagggaacaatatattgtaccctttaatgtgtaaaataaatatcaatagtttttagaataataccataaaaatcatgtcagtacattgtagtggcagataatcccatggatatagaggataagtcacttgcattatttttcaacagtttgtaaacatgtgtctgaacatgaccttaagatatttcccattttcttgctaaatagatagaacaagagtagagattttgttcattcattaggaacatttttcactgaacatttgtggaagaagcatgaggtagtaattgtttattcttggaataagtgaaagtagtttcaagagagtgtattatttcttttgtgtctgtctaaaagctataaagctagaaacacaattttaaaatacataaggagaggccaggtgcagtagctcatacttataatcccatcattttaggaggtcaaggcatgaggatcacttgagaccaggagttcaagaggagtctgggcaacatagcaagaccctatctctacaaaaaaaaaatgtttaattagctgggcatggtggtgcgcacctgtggtcccagctactcgagaggctgaggcaggaggatcacttgagcctaggatgttgaggttgcagtaaactatgattgtgccactgcactctagcctgggtggcagagagataccttgtctctaaacaataaatgaataaacaatgaaaatgtaaaaaatacatgaagggcatacatacttcacatttaaatacgcaggatagatagttaatcacaaggctaaacactgtgttcgcatatagagcaacactgtcatatacttgtgtcaagttgctggtcaacgcaaacatttacagcacaaaagagaaattgtatgtaaatgaaaaaccactgaaatatctgtcacaatgtccatgcactaaagttcatgtaccttcctctggaggagagaccttctactgctggattagagtttaatcagatttactttacatgtagtccctgtacagtttgttctagatttctcagattatcattattttgaagtaacacattataaaatttaatcacacatattttgcacttaattcttttacaatttgttttaaatttttaagattatagttgtttttaagcaacatagtataagaagaaagtttcagaaagcaaacctaatgacagccaaaggaactgatagaagggaaagagatggaaaaatgattatattgcagttgcaattgctcgataatcttcatattccagcctgtaaggtcatgaaagaaaactttaaattatgccattgttgaggtttcatctcgtcttggctttcatttctctttctcttgctcttttttcttttcttctattaatcagtcttctagtcttttctcctttcattttctcctctggatatgtgccatatagcaacttatggccttcctaggtaattcttggcccctaatgccagttcacagggatagtgagaatgctgggcaattatttaacctgtttctttttaaaaatctagataaaaacatggcacaacacccaatggtgatcttcacaaatattgtggacatttttttgttgttgtcgttcttgttagatcctctaaaactgccttaaactcttaggtttttctttttcctttttcttctcttcccctaaattcctgaagcttctttttagtcagttttgttcgccatcctctggattcctggaaaccattctaaattagaaaatctacttcatttttcatccctgttttattttttctggaataaataaccccagcctacttcagccttttttctgtttctgaggataccataccaaatattttcttataatgtatcccacagatgaatagaagactgaacttttataatctaagctaagatgtagataccacagtaaatacctgcatctgattcaaaaggtctatgtaggaatttaaactaaattctagcagaaaaactcatttttatttatcagtgtgatagagccttctcatatcatgtgtgaggcttcctgatcaactgctaataagttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatctgcaaaataattatttactgagagtctattatgttcggtgctgttaggagctacgaagactatggaagcatgttcttcaagtggctttttataaataatgctttataattgtatactttttgcagtcttccaaggactttcacctgtattcgttatttatttttagtttttagcaccatgtaactgaaagaagtcttaagcatagactatcacaactcaagctaagaaatctatcaactagggttctaaaaatccagttaacctccgaggccgcagatcacctgaggtcaggagttcgagaccaacctggccaacatggcgaaatgctgtctctactaaaaatacaaaaaattagccaggcgtggtggcaggcacctataatcctagctactcgggaggctgaggcaagagaatcgcttgaacccaggaggcagaggttgcagtgagccgagattacaccatcgcactccagcctgggcgacagagtgagactctgtctcaaggaagaaaaaaaaagagaattcagtaaacctgtttaggagtcatttagccagccgttgtatctctagccctgtgccctttccacactctgaagaaaaaaagtactaaacagttggtagtgaagagaattttctagagtctttttctagtcttagtttagtatattccaggaactgctgaagtacacacacacacacacacacacacacacacacacacacacacatatcagtcctatgtaagtgtatgctattgttatcaccattttacttagagtggaattaaggcacagggagttaaaacatttgcccaagatgatacaactggtgggtctatgtaataaaatgtctttatggcaagtttcttttggtatttcaggtaaaacgataatatcaatgcatccaagatgaactttccttgagcttaactccattccctatcaacctgttgtgtagtgaggtactggctggtcagtagctcagattatgtcttcctataatgtcactctataataaagcttcattatgggaaacccataaaagagctctggcattgacatccacacccccagctaaacattgttttgagattctaaatactaccaatttcctatttttaagtgacttttttgtcatctttgtctttgcagagtgatgtgtggtctgtgggaattactgccattgaaatggctgaaggagcccctcgtgagtaaaaaatgtttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaatatttcctaaagtctaatatcttaactgggaggtctaaatgaccagttttcattaagaggtagctagccaactataaataagtaatatcctctatagtattttctgatgatattactgtactgccattaatgggcatgttcagttgtttccccagtaatgggatgaactgatggcaactatttgtgaagtttcttgtgttgcttatataggcagtcagttatatgcagccctgttgattagtacattaaaccaaacacacacagacctagagcagaagacttgttttcccagggcacttacatgccagctaaacttgggaatccttctctctgaagcttgttgatcttgtacctgaaactcttgcttattattagtttttattgctttccctggtagaagtggtgactgtgatttgattgttaacattctgcattggaattcaatttaaccctttccatggattcagtttttatggccacatctgttttcatgggtcattttacaagattagttagtcctggtgcttttaacatcctatttttggatcattatattcattcctctgtagttaaaactgcatatagtcaaatgaaaaatacagagtatgactgctgtgggccgatcaatctagtcttgcagactacatatatcacattaaccatttaatcatcatatctgcacttgagtttttaccaggtacatacagttaactcattgaaacttctactgtaatttagatggaatatgctattgactcttgcttctttttctgaggtctaaatggcctcactttataacgtatgttgccaaactgcaggatatttggcaattgagaagacaataatacctaaaggcaactctctccaaatatgattttcagagaggcatgtgggtggtggtgggaagaggtctgacaggactgagaacacttttttttcctctctttgactcattttttaggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgcagttacacctggcaaatgttcatatttatgaagaccttgaaagcatccaataaagttttgtgatatgccaattttaagtaactaactaaataaaataaataaaagataaaaggtaacaaaatgtatatcttgcttttttttcagctggtattttgactctacaagagataaatggatttgtaattaaccatttattcactgctaattttgaagtagtatttgtgcaccatacaaagcttgttttatgtactaaactccaaatataaaatataattaaaggaactgatttatacaaataaacataaacttctgtctattaataaaagtgaacttctattaaaaatggcaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcaggtgcgttccacaaattgcatatataatttgatgatagcaattcacataaggccgttgattccatactgttgcctttggttcagaaagacttaattctttctgatacaacaaataacaaatctctgtttttaagagatattgagtgaaaatgtgagaattctttattactacccaaagactccttaatatctggcaagtgaagatcaagtagatatcatatttcattaataattgaatacattagtaatacaaatgttacctgcagaatatttcagacatcaagggaatgatttcagaaaggtttactgaaggtatcttcattgcagaaaatgtccatcttttaaagtaaaaacaatgcccctgaatggctccattccactaaaaattctaattgtatgccaatcatttgtgtgtttattttagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagtaagaatttttgatatttttactctgagtcaaaaatgaagagaaaatgtgatagctcatgcggatgttttttctcagtaaaaccaaatgaaataaatattccttgtgttctacagaagatatactaaataatttgtacttcaaataaattttcatgaaatttctagataattgtaactaaatatgataaaaatatttttcagtatctctactgaaatatagctttaattattagttttctgtctattattctttaaccaataaagtgtcaacgaatgcacattaaaaattactattttggatctttaaaaattactttcatagcttaaaatttcaaagataactcatcaaaaataagcacaaaacaaaatttgcttttgttactctaacctttaagttagtttattctttcttccaatagaatgccaaactatactatttgagtgaattacactcatttttgtactacaggatgtttaaatcaaggttaaaatgagaaggcaaagcagtttccaaaatatttggtatatggttaccatatttatgacttgtttcactaatttgctgcccgttttacataattaatcaattatgtggcctcacagaacgtgaaacaatttacaaattattctccgtgttagaagaccaacaggttcgtatgcccactgcatagtaacagaccaattacacatgcatcaagaatgcagcagaagagtttaatgatcagcagggcatggagtgaggaggtggggaggagaccctcaaatccatctcctggaggagttctgggatggggtttttaaggggattgtagagggtgaggtgctggataattggagttgttgattggtcagggtaaggttgatggtccttgaaatcatcaggatgtggaaactgcattttttgatgagtcagcctcttgtggggtccttcagaccagttggcgtcagtggggtccttcagaccagttgattgacaatagtttcactggtatgcaagacctgaagaaatatctcaaaggaaaaacaacatttcataatgttcaagttgttatctacagagcagttaaggggaatgatgatgttgcaacaaggtctacgtgagtctaggaaaataggcaacaaacatctattgaggaaggaggtcagagagcaagctgacctaaagattaatgctaaacgtgctgcaagcttggtatatttttgtttcttcccctctcttcttctgtgattaattttataagttaataagggtggtttcatctgtacccttttgaaatgtggaatacagtgtgttaaactccattttatctaagaacagtcactaaaacgtaattgtttcaaaaatcctttaataaaaagtgaatataattttactggagttattgaatttaatctggtggattctaaactgataatgaagaattatgggcttgataacaaattaatgaggttagataaggttaggggagcagttgttttctaatactccccacatccatttgtgtaaaaggaatcattgtgatgatcctaacttatacccttttatccacatctatttacccaataataatcattgtaataattacaaatgaattttatctgagtatctagataaggaattctttgagtttgtgcacattgagccaattaaacaaatgctaatttgttgacatgtttaacatgagaaaaggtaggagcagcaagagaagcaaggcccaaaagggaaaatggatgtctagttctcagagaaaaagggaactataaggagcaagaaactagatggagaaaagggaggtttaagtctagaatggtgacatttggcaaaaactagctcatctaaaatgctaatgattattctcgatgaaccctagtaatcaattagatctaatgggttttgcatttatgaataagacttttattgatctctgaaagattcagtgataccagcatggcacacacttattgtcatttattgttttaaacatatatgtggaaagccattctaaaatttttaaaagtcaataaataatagttaccaatctcatgactctaggatattgtacaagcatttatatctttatatgtggtcgttgaagaaaatataaaggaaaagaaaattattgataatatagtcaaagtcacagatcttcatgatacctgaaattttattagagttgagagacataggtgggtgctttaagtcaccagcaggaaacaaaaaatgcatttttattaatctttcagttgaagagataatattgattggattaaaggggaaaacagtttcctaaagtcctagatctcaattagggagaaatatttgcaccactgtattacagatcttccattgctcaggaagaccaaactttggttataatagcttgctaaatgtgacagttagtttggtgttatgagtcaatcaagttttaggccagagattcttaacctggaccctgtagatgaacttcaggaggtcagcaatccaccagaaaatatatgtaataggtatgtctatatgcaattttctgtggacagtctatagcatttctcagattctgaaagggatccagaaccaaacactattagaaactactggtttaaatcatttttaatatttggatattattcttttaaattgtgtattattttaaattatatattatataatacatataaacaattcagcattaagatgatgaagttgttcctatcacttgcattttaacaacaattaaaacaattactttcctttttgtttcaaaggacaaagaagatgaatcatcagacaatgatgaagtatttcattcgattcaggctgaagtccagatagagccattgaagccatacatttcaaatcctaaaaaaattgaggtaaatttttcaatatgagttgttgtgacattagtaagaacccagaacagtggttcttaaactttttggtctcagtgtccctttatactcttaaacattgaggacctcaaaaagctttcattttttacatgggttgtatcatttgatatttaatttattaaaagttaaaactgaaaaacatttaaaatattagttcatttaaaaggaatgaaactattacatgttaacataagaaacacatttttaatgaaaaaactgtattttcccaaaacaaaattttagagagattgacattgttttacttttttgtaagtctcttaaatctatcttgcttaatgaaaaacagctggattctcacatctgcttctgcattcaatctgttgccatgtgttgttttggttgaagtatacgaataaaagctggcttctcacatataggtagtgggaaagagtcaattttcatagattgcttagataattgagtaaattattgaataatgtaccaaaactagagaagtggaatctaaaaccatatcaatgaaatgttgtatattcagttaataataaaactcattgatctatcttatgctatgaatagatgttttgcttatgcatgatttttaacttcatgcattgatcagttggaaaatactggttcactttgtatatagatcttcccagacatttacatgtttcattatacaatatcaaaaaacagcatttgttaatgttaccatcaagttcatcataaaagttactgagtgttgttaaattgtcaagtgcttggtgggagatatgtttgaaaattctaattttcctttgcaagctcaaattttatcattgctaaattgtggcatcattttttccccttaaattgacaggtttactttattcattaaaaataaaatgtctaccaaatacccagagtttaaataatcatagtttgtcagtctttctttaagcaaaaatattgtacattaaaaattctggcagtttcgttttgtaacacaaacacaaatatttttccttgattagctctggtctggaatgcagtttgtgacagggtctgggacatttaatctatgttttgttttgttttgttttacaattataagaataattaagttagtcctagtgtccattttgacttctgttttcatgagtatattaatagtatcctatttagaacatatattggtgaggccggagttgtaggttttcttgtctagaaaaggtagcatcatcatcatagccagtattcctaatagccagccatctaaaacaatctttttgtagattgttttgaacaatcaagtagattaggtgagtgtgtgaagaactcaaactcttgccttattgatggtgggtcaggagcctcattgttgctcctaatcagcacaagatgttacacaggagtctactatgaagtcttttatggacaactctcatttttaagtacaattcccctaatactaacagtcctctgaagttaataacaaagagtattgttttataagtactaaccactggcagaaggtacataagccagactgtattatataattagaagaggcaatatgtctttttctttgccttattaaatgactttactcaaactcacaggtaataattattaccttaaacctgacactttaagcaggaaatgtaatgagctgtgtctgatttgaaatacatcattatcttagtatatgctattcttactaatcattttcttctccccagttttgaaattaaatacagccaatttatattaggaattatattttttatttttggccgttacctattttgagtaatttttgcctccagtagtgacaataaacttcctaagatcagcttcataagccaaaagtccccgactgggtcatatgataccaattatatgaaatgaaagtggaaaaaaataggcagatacttaccctcacctacttgtctctcggagtgtagagagagccttgataagccacttcataaagaaaaaatagtttactaaggctactctagtttctagaaagtatagaatgagtttatcagcatgcatatgctagattaaaaaagtaacactcttaaatttcctttttaaagaatctagtatgactgccttattgcatgtcagaatgacctatgttttgggcagctaaaacttctttgagtagaaacctggtgatacaagtcttagtgaggcaaggcaacattccctggccctgtctaccaatgttggcagaaagtaaaattcccccattggtggaagctggcttattatatgcaccctttcttgagtatttggctatattcaatgattgtatgattagtaaaatgcaaattaatctatttagagttgaaacagtacttggaacactaattatgatagtacagtcaaattgtaaagcagaaaaacatactttcttactttcttaaagatgggacacttttgactagagagattttaatgaaatgtatgtatgtgtgtgtgacaacttttgaaaatctagggttagcttaaaaggatgagtgtataagaattagaacttaaattctgagtaagaagtttaaacttgatataaaaagcaatgtgataacatggaaagaacattaaattagaagttgggagacctgcattctgattttagacgttcctttcacttgacataaaattcttagaaaagtcattttccctctttaggctacagattcctcaacaataaattaagattttgattatatgagctccagaatctgttcctatactaaagatcaaatataccatcagaaattatggttaagcaagtctaatgttgtaagtcattatgaaatagaatctgtttattaaaatcatattttataagttagattttaggaaaatatatatgaagacaggcattttcccacaaattaagagctcagtacaatttatgatcaagaattctactgaagtattgcattgtgtctttaaggttcaagagagatctccttctgtgcctaacaaccaggatcatgcacatcatgtcaagttctcttcaaggtatgtgtctttgatttctatattaaaattattcataattatcaaatggaaaattaaaaattatttcattgataatacactttgtgaagtcaactaaaatatccgtgacaacatcatcaccattgactttattggcccacattgaaaaccttaactgcaatgatccattacctatatctttcatatttggtcatactgcagtctctgtgatatttagtttgctaaatagatggcaaggttcacaattttaaaaagaaacaataataacaaatactttgacagtattcaattagtagtcgatgataaaaagacatgaaatttcaagtgaattttcacacatgtgctgcatgataaaacacacacaccaattgtctttaacttcagaagctaatgccacagaatgggtaagcctaaaaatgtcctatagtcaaaatcaaatctaaaactcaatattatataaataaaatatcatatataatattgataccagtcactgtattttttaatctttgtaatattggtgatcttcaataattttcaaagatcacgttccatatgtcagatattgtgtgcattctgttatatttgaaaactaaattttaaggtagatttttttaagaaaatctcaccccctccagccccaactcacaatagagagaacttagcctatattgattcatttagtcagtaaatatttattgaacactcactatattcaagatattggacagtatggccagatggcgtacagttaatgttatgtagtatatattttcttgcttcattactttaaaaaacccatacaattatgtcttcagatttaactggagtgcagaaatcttgaaaaattgtaaagcaagactgcgaactttctttttctctgcactcaatgaatggattgtcatggtcgaactgacctcaaaggaaagaaaccagtttagttttgagtagttggttttggtatcatggaacatgactttaataaaatccaatatataaaatccatacttggtgttaaactcagagtaattgttcactttacaaaaggattttgaatttatgaataacaaatacgttgcctttaaatatagttaaatttaaaaagttaacttaaatgaaactcaaatctttccggaaatttggggccatggaaaaaagtttgtctattccagacctaaatcaataaccaaagtccttcccatatagaaataccaaaataactgtaaaatttagcagcattagtccaaagaaactctctaaatattctttaaatttgaatagtaagaacgaaagtgctctatttttctgtcagtgtagctatctaaatccggaatgggacgttaaaaacattaatttcaagcatttaaaatctggataataacaatagaatatatgacataacagtaacttgtttattatgttaaaatactcacatacactataaggttatgtttattgctgtgttactcaggtaaaatattgtctgaatgttagctttaaaagcttatagaaatttttagaaattaatatatatataaaggaaacatatactctatgaaaacatatttttcttattttggaaatcgttactctattctagacaaaatagcaagtttgggggagaatggaaactggaaattattactcaagttatacttctttttcagtttgatatgtacccatatatttaaacaaaactttgtgttggactttatgttgagttgtacattccctttatgaatgttaggacatggcacatgcttttctgtcttttcattagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtggtcagtggtggcctttgagaaatggaaaataatttttctgaattttcttctttttgttgggtagtagttaggaatgtgtctaagaaggcggggggagtcagctttattaggtttctataccacgtaagaaaagtatggtaaagaaacttgagagagacctctccagcaggctaaaatttataggtagcaattagaatattgtatggaggagttgtgagtgtgtgtttcatttatcagttggttacttcacctctccaaaataggacaatatctgataaatatccctaaatgttacagagtgatggttttactcaaaatacatgaacaattaatctatcaaatcatagaaaataacttcaaaagttgtgatgtgaatttcaaaaaagtattttaagatgtgcttttgagagagtttaaatgaattatagatttatgaaatattaggataaacaaagccaaaagttgtgccatggatcatgcaatctggcattatccagttttaagcaatccaggtaagttaagcaagggaaaaatggctgattgagttgctgatatgtaaaaatatagtatactgattttattaaaatgttaataataaaaatgatacagatgtacttcactttttgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaaaaaaaaaaaaaaaaaaagcacaagtacaacagtgtcagaagatggggacacaaattttagcatgtgttcagtgtaatgttctcaaaggacagcagtatttgcaaatatatgtcttttggagttggagtatctatactttggctatgtataccaagactgaaaataagagggacaatagtatttatcttgaaaatctaagcacacaaaaacattaaacagggacctgagttttctcttagtgaagctttttctaagtacactcacccagacctgaattttgagcctgttaaatattctcaccagattttaatcacaggggttatttaccataccacaactcaatattaaaacctaatctccaaaccagatacatttgtattttaaatggaaatatttacactatagaattgagctgttcaatgtggtagcaactagcctcatgtagctattaaaataaaaagtaaaatgaaaattaaataaaatttaaaagtcactttctcaggcacactggccacatttcaaatgctcagtagtcatgggtgactaatgaccactgttaatggacagttcagatacagaagatttctatcactgcagaaagttttgttgtacattgctgctataaaaaggttcccagctttatagaaacgggtgttatctcttttcagtagttcactcctcaactgtattgaactacatctggatatatcattgggtggaaatatgtgggggttaagattgaagaatgtaaatttgtttgagttcattgtagattctggatattagccctttgtcagatgagtaggttgcgaaaattttctcccattttgtaggttgcctattcgctctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgaaaggaagggatccagtttcagctttctacatatggctagccagttttcccagcaccatttattaaatagggaatcctttccccattgcttgtttttctcaggtttgtcaaagatcagatagttgtagacatgcggcgttatttctgagggctctgttctgttccattgatctatatctctgttttggtaccagtaccatgctgttttggttactgtagccttgtaatatagtttgaagtgaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaagttggatttacaagataaaaacaaacaaccccatcaaaaagtgggcgaaggacatgaacagacacttctcaaaagaagacatttatgcagccaaaaaacacatgaaaaaatgctcatcgtcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttttagggacgtggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggagtggggaggggtagcattgggagatatacctaatactagatgacgagttagtgggtgcagtgcaccagcatggcacatgtatacatatgtaactaacctgcacaatgtgcacatgtaccctaaaacttaaagtataattaaaaaaaaaaaagattgaagaatgaactctcctcttgagggttttggctagtctatcatcttctaataaatacactgtcgggcttttttttctactggtcagtatgtgaggccagtggtactcccagtccttcctactcttgatacatttttttaaatgtatctacctggctatcagttggactatgtatcttcttacatagatagagatatttggtaagtgtacacttaatattgaaaacagagcagccatgtaagtctacagatggaagaaaacttgaacccctgctaatacccctgaaaagagaatttaagatcctggccccatgagaattttcaggtgatacttcctgaatggaatcataaaaatgaccaagaaaaaaaaaaagaaaaaaaaccaagggatttaactgatacactatacatatgaaggcaatggctgtaatcaccattgttactaatgtgtttttggcattccatagaatcttcttctgaggaagaaagtcctgtgactggaaggaggtctcagtcatcaccaccttattctactattgatcagaagttgctggttgacatccatgtaagtttccatcttaacacattaatgtctattattttttattttccatttattttgacttacacattctcatattcacttgagggaaaggttaaagagtttagttttttaattaacattttaaggatagattctcattgctttgtgaatacatagaacacaaaatctagaaattaaaattgaaatgggaaaacatttaatcaatcagagaatattttattttcacattcttgtgtcagttagaacatgtctgggagagtagtgataacaagctgtttgtaaaacctaatctcagattgaggggtacaggttagatgtccaacttttaatagcattccttgagtgatgaggcaatgcataaatataaaacatttagtaaaaaacagagtgtcctctgactgcataaataaaaagtcttccagctctttgtgaacatgtttaaattgttctaatgcagattttaaattgtcctaatgcaatgtgctttcagattattctatttcaattttgaattacctctatgctaccgtacacacatcccttccagattgcccaaaagttgttaaatgatacataccatacttaaaagatggatttagattaatttgcactttggaagtgtttgagatactttaagacaacccatggcacgtaaaacctgagctggtaaattaacatatcaatttcaagagctgtgtgttaatcccaatgtcaggggataaaacaaaagggaaaagttaccatttttaaggagcatcaaatctcctgttctctccagcatcaaaagcaagtgtccattcctgagctgacaagtatgggtattttttttaagtgagtaaattttgccctatgtgatccagaaaggccactaataatcacagtctgatgtttgggttttgacatctcatcctcactaaaattttggctccatctaatgagtgaacatccttgtttcagtttaaaatatatttcaaaatgttgtcagcttggaaactttccaatctagaagaaaatgaaagctactagaggctacattaacctttcttgtgcacacaggttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaaggttggtttttttgaattacttatactctccatgttttatgactgcagagctatttgcatttttggtttattttcaaaatttattaccaagagagtgacctaatttcacttgcattttagtaaatagtttgattgtcaataatgtattttaaattgttctaatgcagaacatctaattttgtgtcatttgtgtattttaaaataagcattcaagtatttattagtttctttataactggaattgtctagatgcttatgttaaaattactgccactgaatcatcctactctataaaactatactgagtatgagaaaggacaacaaagaaagtgtgtaacttaacaagcataagatgaagtcttggtatttgcaaacatagctattcatttctcaaacttttgtgatatcactatatatatatatatatatatatatatatatatatgtgaaatttaagatgatctttatctgtttaattggtggagaaattaccaagagctcttttaattttttccaaccaaaaaagtctatcaagaattccattatgaaataaatttacttttagaattaccacaggcacgtatgtttaattttgtttcctatgcaaaaagagagcattggcacattttgttaagcttagtatttttagcaattaattaaataacttagttccacaagacatgaggtatgtattgctgaacttccttggtgggagtagtagaccaatggagttctatagcaaagcagtcagtacacatgttagaaaatcaaggcacatgttgaaatgaacacaaactagatatactgcaagaagaattaatcatgttgtggttgagctaaaacataggcttaatcattcatgtgtctgtgaagttgctaatgcatgaaatagtatatatttaagaaaaaaactacatattcttgctgttaacctaatacacgcacctaacaaagaatacaagttctcttccctctgccatccaaatgcatctgagaaattggtggtggctatggctttaatcattacataagactgagaagacataggggcatttttatgttctttatcataccagtagtgttcacatagaacaaagacaagcctgggcatggtagatatgtataagacacatcctaattctgttgtacttgctaactttcaaatgtgtttttattgcgtgactttctttcattaattggagcttgttgtcagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggtaatgcaccatttgaaaagcagattgaactcctctcattgcgaatgtgtttcttcatgggacatgtagcatttctagccattccaaatagattttcatcatataccccaaggccttaaacatttttaattataggtttgtaggtggatccttattacctctaatttgggtggttcctatttacttccaaagacaaaaatctcttatttgtttgcctttattactcagatcacatatttgaggtagtgtctcttgacacacactttttaaaaatattttaaaaaattaattgacacctaataattgtatatatttatggggtacagagtgatattttaatatatacaatttgtaatgatgacatcagggtatttagcatgtctatcacctcaaacattcatcattttttttgtgtgttgggaacaatcaatatcctctctcctagctatttgaaaatatgtaatgaattattgttaattatagttaccctatagtgctatagaatattagaacttatatctcctatctagtcatgcatttggatcctttaaccagcctttctctatcactctcccgtactcctcttcccagcctctagaaacgactatttactctctagttacttgagaccaattttttagcatttgcatatgagtaagaacatgtggtttttatctttctgttcctggtttatttcacttaacattgagtccaggttcatccatgttgctgcaaatcacaagatttcattcttttttatggctaaatagcatttatttctgtatatatgtcatgttttctttatcaattcatctcttgatggatgcttaggctgatgccttattttggctattgtgattagtactgcagtaaatatggaggtgctgatagctctttgatacactgatttcctctttttttgagatatgtacctagtagtggaattattggatcatatggtagttctatttgtagttttataaggaaccacaataccattctccattgtgggtgtagtagtttacattcccaccaacggtatataaaagttcccttttctccacatcttcaccaacattaattttttatgttttgataataaccattctaactaggatgagataatatctcattgtggttctgatttgcattttcccgatgattaattatgttgaaattttttttcatctatctgttggttatttctaagtcttttgagaaatgtctattcaaatcatttgtccattttgtttattatactttaagttctagggtacatgtgcacaacgtgcaggtttgttacatatgtatacatgttggattatttgcttttttctgttgagttgtttgagtttcttacattcaggattttaatcccttgttggacgaagagtttgcagatattttctctcattcttcaggttgtttcttcactttgttgatcatttccttttctgtgcagaagatttttagtgtgatataattctatttgtctatttttgcttttgttgcctgtgctttggtcctattcttttttcccaaaccaatgtccacaagcattttcttatattttctagtagttttatggtttcagatcttacatttaagtctctaatctattttgagttgatttttttataaggtgagaaataggggtctaatttcagtcttttgcatatggatatttagttctcccagcaccatttattgaagacattgttctttccccagtgaatattcttgatgcctttatcaaaaatcaaccacaatgagataaatgaatatgtggatctatttatgggtcctttataccgttccattggtatgtgtgtctgttttttggttgctgtagttttgtagtatattttgaaatctgatattgtgatgcctctagtattattctttttcctcaggattgctttggctattctaggtcttttttggttccatgcaaattttaggatttttttcctatttctgtgaagaatgtcattggtattttcataaggattgcatagaatctggatattgcttgggatagtagggtcattttagcaatattaattcttctagtccatgagcatatgttgcctctccttttgtgtgtgtgtccttttcagtttccttcatcaatgttttatagtttttcttgtagagatctttcacctcattggttaaatttatttccaagtattttattttgtagctactgtatatgggattgtttttgtgatttctttctcagctaggttattgttggtatgtacaaatgttacagatttttctatgctgattttgtatcttgcaactttactgaatttgttcatcaattctaagaattttttggtagtgtcaaaggatattctatttataagatcatgtcatctgcaaacagacactctttgacttcctcttttccaatttggatgtcttctattgccttctcttgccaaattgctctgattaggacttccagaactaagttgaataagagtggtgaaagtggatatttttgtcttattccagttcttagaggaaagaatttcagcttctctcattcagtgtgatgttagctgtgggtttttcatatatggtttttattgttttgaggtatgttacttccatacccaaactgtggagagtttttatcacgagggaatgtagaattttatcaaatgctttttttggtatcttttcacatgatcatataatttttgtctttgattccattgatgtgatgtatcatgtttattgatttgcatatgttgaatctcccatgtatccctgggataaatcacactcaatcatggtgtataatatttttgatatggtattggattcagtttgctagtattttgttgattatttttgcatctatcttcatcagagatcttggcttgtagtttttgtttgtttgtttgttgtaactgttgtgtccttatctggttttgagatcagagtcatactgacctcacagaatgagtttggaagaattcccttcccttcaacttttttggaatagtttgagaatcgacattagttcctctttaaatctttggtagaatgcagcactgatgccatagggtactggacttttctttgttgggagactttttattgctgattcaatcgcattattcattattggtttgtttaggctttctatttcttcttggtacaatcttgctaggttgtatgtgtccaggaatttctccatttcctctagattttctaatatgttgctgtgtagtttttcataatagtctcttatgattctttgtatttctgtggtatcagttgtgatgtctgcttttttgtttctgattttatttgggtcttttatactttcttgttagttaatctagctaacggtttgtccattttgtttatcttttcaaaaagccaaatgttcatgttgtatttcttctgtattgtttttgagtctcaatttcatttacttttgctctgatttttattatctctttatttctattaatttggggtttggtttgttcttgcttttctagttcattgaggtgcatcattagattgttattcaaaatctttctacttttttaatgtagtcatttattgctataaacttgtctcttactactgcttttgctgtctcctataagttttggtgtgctgtgtttctatattcatttgcttcaaataatttcttaatttccttcttatttattggctaattgatgttcaggagcatatatttttaatttccatatattgttacagttttgaatgtttctctggttattgatttctagtttattctattttggtcataaaggatactcaataataatgttgatttagaaaaatgttttgagacttgttttgtgtcccaacatatggtcagtcttagagaatgtttcatgtgctgatgaaaataatgcatattctgcagctgttgggtgaaatgttctataaatgtctgttaggttcatttggtctatgctgcagtttaaatccaatgtttctttgttgattttctgtgtagatgatctgtccaatgcagagagtgaggtgttgaaattctcaactattattatattgtagtttatctctccctttagatgcaataatatttgctttttatatctgggtactctagtgtttggtccataagtatttataattattatatcctcttgctgaactgatcctattatcataatataatgtccgtgtttttctcttttttacattctttgacttttaacacctgttttatctgatataagtgtagctattcacgcttgcttttgatttctgtttacatggaatatctttttccatttcttcattttcaatcagtgtgtgtcattacaggtaaggtgaatttcttataggcaacatataattgggtatttttatttttttatttttattttttttactttttaactgttctactagtctatatgtttaattacagaattttgtctgtttactgtcaagtttattattgatatgtgaacacttactcctgtcatttcgttaattgtttctggttttgtgtatccttttttttctattctcttattgttaatctatgttgttaggtaatcttttgtagtaataaggtttgattcctttctatttcacctttctatacctgctttacaagttttataatttcatgttttcatgatagttgttattgtgtttttcctttcagatgtaggactcccttaagcatttcttgtaagacctctctagtggtgatgaattcctctgctttttgcttatctggaagaggctttatttctccatttctgaaggattgctttcctggtgatactattttgggctatcaggttttttccagcactttgaatatatcatcctattctctcctggcttgtaaggtttctgttcagaaatctgctgttagtccaatgaggatttccttatatgtgataagactctccttttgctgtttttagtattctctctttgtcactgacttctgacagtttcactgtgattttctttgggaggacctttttgagttgaatatatttgataacctttgagcttcctgaaactagatgttcatatctctctcccaagacttgggaatttttcagcttttattttattaaataagttttctacatcttttcatccttctggaacccccataattcaaaaatacatcctcttaatgttgtcccataagttctataggctctctttattctttttttttctcttttttcttttctgcctgaatcattttaaaagacatgtcttcaagttcagaaattctttattctgcttggtctagtcagctattgaagctctgtattgtattttttaatattattcattgaattctttatcttcaatatttctgtttggttcttttttaatgatacctattcctttgttgaatttctcattcagatcatgattttttaaaatttcattgatttgtctatctgtattctcttgtatcttgctgaatctccttaagatcattattattaattccttttctggcacttcactttttcttttctgttgggtctgctactggaaaattattatgttcctttgaaggtatcatgtttccttatttgttaatgtttcttgtgtccttgtgttgatatctgtccatctgatggagcaattgcttcttataatgttatggagtggctttcataaggaaagacttagtccatagatgggtcctggggtgttggttgggttgggtgcattgactttggttctgggtggatgcagcagtgtggtctctatgctgtaatatacattagcaacgtttgctagtacctcactggcccaggctgcaaaagtttgtggcagaggtggcacacctttgccaggggtgggcttgccaggctgtttctcagtccagaggcaaaagtgcacatgcggtgggttgggtggctcaggaatttgccctccagtgttgagctatcagactacttctctgggcaagagtgtggtcacacagggtgggaaagctagcttggggtctggcttactgggatcagtgctgctgagctgtttctctggccagggttgcaagtgcacagcagttaagccagcctagagttggcttcgccaatgtgcagtactggagttatggctgacctttcctgggcccaagatctgagcagtcagggtcacagcatttcagccatcagttggggcttggtgaaatgacagtggagctgcaagactggagaggcacagtgtttactggcccccagaacatagtgtatttcagcagtgcctctagattcaagatggcaccaggctgcagcagcttaggtcatgggttggtgggaaatgcacaacttttgctccttatctggagcaatgcagacacatgaatttcaggcaccttcccaaactgaactcagggcttgtgaggactatgagattctcctgtagtaagtactacagttgtctgtggtggcaattggggctgatgagagtcttctgcttaccttttcccaataaggagaatttattccgggctctgagctgatcatggtaggggagatggggcagcagaagcagagtacctcacttccctctctttgctgccattttgagattccatgctacacagtgacctcaccaccccatcactgcactccaacactctccctcagacacaccagttgaactctgtttattcattctctttgtccttttttgtgagggggacaagcaccaggtgccaccaataagctatcttactgacatcactccaactggaaccgattatttttttctgagtttttttttattgtagtaaaatatgcatatcataaaacttaccatttcaaccatttttaagtgtacaaaccagttggatttattacattcagaatgttgtggggttgtcaccactatccattttcagaacttattttttttaccatcccaaacaaactaaacaattaagtcttgtttcccccctcctctaacccctgataacctctattctacttttttttcttggtgacttatataagtggaatcatacaatatttgtccttttgtgtctggcttatttcactttttaggttttcagagtttatccacattgcagcatgtatcagaatttcattccttttcaagggtgaataatgttttatcttatgcattcaccacattttgtttatccatttatctactgatggaaacttgggttgtttccaccttttggttattgtgaaaagcgctgctgtgaacattgatgtacaagtatctgtttgagtccctgctttcaggtttttggggggtatatagctaggagaggcattgctatatcatgtaatcaggctatgcttaacttcttgagcaactgataacataaaattttaattcaagaaatatactgtgtttagacaatgattttgtcattcacaaaacatttattgactttataaataggtttaaaatattcaagtagttcacagatgctacatcaatagaaattatcacacataatattttctgaaccatgtggtatttgaactcattcttgagaaatggggagtatctggatatctgaaaacacaggtggaactccagacagaaaaaagattatgccagtctactcccctagcctattttcttgtcacacaaactggctttggagatgccatgctctttcatgaatcagcgctcctgtgcaagctgtttcctctggaaggctgccccctcacctcttctctgcttggtaaattagtaatccttcatgggccaaattaagtatcaactttgacttcccaaggcagagttatatatcccttcctttctacttacaaaccttttgtccatagttccaatttagtacttatggtattattgttagttattttatttttttgctttcatactatattgtgaactcttaaaggaaataattatgtctaatccttccatgattatttgtctaccaactcacccaacttcagtgtctaaccaaggacatggcatatgataggcacacagtaattatggaataaatcaataaagtttgaaaagaaagaaaaaaaggaaggaaggaaatttcctggatggtttctaatgggaaagcagtgtcagtgggaaaatatctatgtctgtctatctatctatctatctatctatctatctatctatctatctatctatcttaattaaagacattaaaacaggatgtcccaacataagtttcatagcaaccctggttatatccagttatctcaaggaatgttttggaaatttatagaggaagtggatcttcctttcattttaatttaaaaaggacgtgatgtcataccatgtttttgtggttgaaaaggtcataaaaaccagtcttttgcagaatagcacagctctctcagtgccaagaatcactgtttagacacaaagatgagcttatcaacagaataacttaccaacaatagttgacatattttcccacaggacagggcataccacataaattgtcacatttcgtggcttttatccttgagtatcttctttgtaagttaatggaagccagctacattttcagtgatgcatgtttacgctcttggatttgtgttggttgatttgccttcattttctttatcatttgaaaattatttatgcaggtttttcatgctttcagttttgtgaagataccttaaagcagtagaacagacacccccacactgtgctttatattttttcaagaggctgtttggcatagcatagctggatgtatgctttggaatcagacagactttggcttcaaattctgcttcccctacttactagtactatgactgaatacattatttactgtctctaaattttaaatttgtataagtaaattggagataattatacttacttgttgggctatggtaaggattcacaaagatatctaaatatcatgcttagcacagtagctgatacatggtaaaaattccacaaatgttaggtctcaaattgtacagttgggaacctatagctccttgcttttctcctgtaccatcagtcatctcaataataggttagttttctccttctgatgacattgttgagtttttctagtaaatgtggattttataagaatgtagatgttatagatcttgcattgtgtttttcaaacgacccctcactaggcatatttctcccactgttaacctactaatgaaataaaaattggtttttggacttcttttaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtgagtgtgttcaatgtaatctctaaatgctactatctgttcacttattaaatagtgtttaaccactgcttcatgatctgttaggaatcaaattattctcacattcacttgaaataaattcagattgatatatgcttttaaaacatctactctttactgaatctttatggtacctaaatttgagctacaattgagaaattgagtcccttatatggatttatgtgtgttttctaatcacaataacttaaaatatattcgtgttcaacaatgtattttagccatcacgatttgtgttatctgatggtttcagagttactgaaactatacttccagtaaaaaataaaatacaataaaaggaaagaaatttatttgtttttttattttgaaataagatctcgctctgtcacttaggctggattacagtggcaggatcatggtacatggtagcctcaacctctgattcttaatgatcctcccaccttggcctcccaagagctgggattacaggtgtgagccacgacatctagccaaagaaaataaatttggctaagtcgtgtctcatttgcggaaacactgtagcatataaggtgtacagaggagtaatttaaaaaaaatttttctataactccatcaggtgcagatttttctttaaaaaaaaattctgtaactccatcatgcacagaactagtaatttcccttattatcttccccttacatctttgcagtatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggtgagtttgttttgttttcttaaagaatatatttttatgtagcaaacctgtgaaaatcatagacataaaatatttgcttactcttaccaagtcattacaataaaaatatatttatagtagttaatttgctcagaattggttttgctgattttttttttcactcagtgcagtttgatgtttgaattgacggcccccacctttgtattctatttcttttaaacctgagttaacttggatggcaggtggatcacgaggtcaggagttgagaccagcctggacaacatagtgaaactttgtactaaaaatacaaaaaaattagctgggtgtggtggcaggtgcctgtaatcccagctacttgggagactgaggcaaggagaattgcttgaacctgggaggtggaggttgcagtgagcagagatcacgccactgcacttcagcccgggcgacagtgcaagactctctctatatatattatatttattatattttatatatatatatatatacacaactggactaggttatgattgtttgaaagtttaagtttcgtatttctaatttagggtagtgttcaacatgtgatactttatgaggtattccaagaaatatttctgcaggatcttgtttttaaaaagccttggaaatttgtagagaaagttccttctataatgtcttaactctgatagactttttaaaatcctttttttcagaagaattataaccacattggcaatgctgagacaatattttaccgcaagccaatctgaatcataaatgaaacaaaataaatgaattcaagaaagggagaaatccaaagtaaatgccaacctctgtcttgcaatttcatagattttgcttaatgtatgattgaacaaaggacagggttttaaattaaaaatagaaaagggtaacaaacattgtaattatgtggattaaagaatttttaaaaatcatctcaaagttctgctaatttagtgtgtcaaacaacaagatagcatgaatatttcagtctggcaactacctagaaatgtagttaatgtctaataatccattcttataacgtgtaattttatattttgaaaaataaaagattatagtaaaaattggctatacttcttcctccttctctgattcccctgtgagaagaagatgcagctcctaaacatgccattggccatgagttagagaactgattaaagacagagtgagaaaatgaaggcaaaatcacttaagttttctccttatgctcatggagcacaggtatgctccaagtgcaaggaggactgtgaaattttatcttgttacattacttggctggttatttcctatgtcactttatggtgaaaagctcccatagtagtttgaagtgtaatttaactttggttctgtcttctatttcagtcctcttatttggtctttaaacagtgcttatatttgaacaaatagagccagtcaacaaataaaagagagtgtagaaattgagatccatgaaggcaggaactaatttcataggcatttggcaacggtaaatttttaatatatgcatgaacatagaatcattcaatttaaaaacaattatttacatataattattttaaaatcattcaaacatttacttatgtttagagatgagaaatgagctgaattgaactctttgtatgtgctagactaagaatgtttaatgataattttcaaaaaggttgattgattttgataaagttcagaacactactaaagggtgctaatatatccataaatttccatttgtgagatggcataccagatgccagccagtggaatactgccagagggaattatgttctatatttttatgtatttcattgaaatttgttctgttggtagagagtacatagttacacagtatgaggtgaatatagcctaaactgataagtcatctttacatagatcagcatactggaatagcaaaaatagtaatatagatgcaattatgaaaaataatatgaggtgaatatagcctaaactgataagtcatctttacatagatcagcatactggaatagcaaaaatagtaatatagatgcaattatgaaaaataatctgagctaatatagcactttttatatatgaacaggagtcaatttgctgttgggaacccgatctaatctatatctgatggacagaagtggaaaggctgacattactaaacttataaggcgaagaccattccgccagattcaagtcttagagccactcaatttgctgattaccatctcaggtttgtttaagaactaaaattagctgagtaattatgcagattaattagtctgcaaactgggttaaagactttctcaggttaaagtgttcctagaagagcactttaaatataacctttaattgggacaccagactttcctacttatattatcttatctatttacaatttaaagtaacttccttttattgtaaagtacctaacctaggttactgataagaaaaaccacaacatttgcatccttgcatgttctctccagtgcagcctcctacaacttcagatttctaattttcatccattcatgcacaggactgcatcaacatccaccatgtcccgttcttgtgaggtgttagaagcaacaaagaacaaagtgaacaataatcagatacaaaagagagttgtccttagtatatagccttatcacaagggcctacaggtagagtttgtaacaagaatggatcccctaaagatctttacaccttttccaaatagtagttaaatttcttagttttggtcagtcagagcctgaaacttagaatacaagaaagcaagtaaatgagtgttaagagtgatcgtgattactaaacagcatttagtatcaggaaagcaccaacattaaagctgactataggcaaaagatgactgacaaaagagagaaaaagtaagaaaatatggtttgtctatgtgaataaaatgatgctaatcacagacacttatatgagtttatgtattttattatatataacatgctttatatataattagtgcacaaattgccatgttgcacactaatgattttgtgttattcctaaaatgattaactttgctttacattttggttagaggagaaatccctttagaggtatgctcagacttcatgattttttaaatcatgttttatagttagttgcttataattgtttaaggtacgtagaagtaatatttattttttgaaaacatctgggtggcttatagactacatatctgtataacagatttctttactttttatccaacttcctctaacccaaatatgttcttctctagttcttgagcttctctcaaatgtggaatatttttccatcaaacagtactgagaacatcagtataagaaggtactcagtagtttaaagcacaaatttattttaccatttaagaaatagaatagcggtagtgttttagtccattctcatgctgctataaggacatacctgagactgagtaatttataaaggaaaggggtttaattgactcacagttccacatggctggggaggcttcaagaaacttacaatcatggcagaagggaaagcaaacatgtccttcttcacatggcagcagcaaggagaagtgcagagcgaaggggggagaagccccttataaaaccatcagatcatatgagaactcaatatcatgagaaaagcatgaaagtaactgccccatggttcaattacctcccactgggtccctcactcaacacatggggattactatttggattaaaattcgagaccatatcacatagatgtagatatctgaaccctaacactgcttcaaaaatgttgtgtaaaaacatatgaaagactaatcacataagtaagaatcctattgttgggcctagaaatcatgtaataataaaccataaaaatgacaaagaaaaatgattataaagtcactatataggggaaaagaaatgtgtgattttttcatggcctgtgtttcctgactgaattgtaagaatttgatgaaatttacaattaggaaattaatattaacgataaatttagttggaggaaaatataatgaaactgttcaactattttacaagcatgctggaatgacagaacacaaagatacccatattgctgtccctgaataccttaacagtcaatattcagccacccctctcgtacacacacactaccagggacagcttttaggtctctgaactccagaggagttatgacttcatgaatagccaaggtacaaatgaatggatggtaattatcttgcctgcatagtggaaggcttaacttgtcccaaaaaaagtttagatccccttctgagaggcacataggtagatactttgactatctcttggaattgagagactaaaataatctgtcatatttccaaatcctgaatgggagattctgatgcaatgcagttttttttaaggtgctttttacgttaataaagatatttttaaaaggcaaaatatctttacttttttttcttctaatatatgaaaagaaagactgattttaaatactgtatattttcttatctatcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtccgtaagccacatttcatgtttactacagctatataaattttgcatcctttcatttggtgaactacataattatgaaaggcaaagcagagaaaggaaacaatttgcagtttcaaatacagacgagatcagggacgttcagggtggtatggctatagacagcaacttcaaatcaaagaagagtaaatttcactgacacatcttccaggtcttctatgttacaatcttgatttttttttttgagaaaacattgactgactaaaatagttattgatgttaggtttggtttacctcctcaccttactttctttcccagtcaccccgaatattccagataaaccgatttttttttcctgcctttatatagcttcagctatataaatggtcttgatttatcttcacaaacttggggagatgcatatgatattctctttctttggagcaacagtaagattgaatccctcctaatactgtccaggaaacttaatgatgagtcagaaagaaaattctgtgatctgctggctctcactcccactgttgatattaatgaatataatcactaattgttttccatctgattagaatgttttcatataccctgtatcttcacaaccatccactgtgaaaggatgtaacaaccctaggggttcagaatcctgctctcagctataaaaaaccgtgagctaatgtcatcccattctgttctatttctgaagcaaatccccctgtactctcagccttcttttgcttctttccctcttcattaattgcctcttcaggcagaactggtggcataggtgagaaatagctggaatcacattatataaattgcaatgggatatttctgtcctgactgaccattattgttctgcatataaagtgactttctcagggtaggtttttgtatgtgtgtgcatatgtacacatacaccactaaagagggaaatgagtacccagataatttaagcattaaataaatacactagtttcttccaggtttaggtatcactacttccctccaaatcatattatgcaaatgtgatagtcctacaggtgaaagatatccccagatgttaactcaggagtttatatagcaaaactacctcctcctaacttgtaaaatattagttcagtaagagatagtcacaaagttactcatattgcaaatctgtgctctttgtgaggggtggactagttaagtttagttttcctggctgaccccattccagtccacctaagctctcagaacagcaaaaagcatttgtcccactgacaggtggaattagtagcatcttcacataggaagacaagaacaaatcatacttgcctggtattttcatagccttccaagatccacaagacagtgaactgtcaccaattactaccctatattaaatatataggaagtgttttcttaagagagaatattttttattattggaggattagtaatcatgctcctttgacctacttgggagcaatgcaaaagaaaatgcaagagtaagctagacccagagagagacagaaagagagagagagagagagagagagagagagagagagaatgcgtagggatggcagaagaaattgcagccaagaaagggctttatagcacaaagtataaatctatcgggtaagacaacatattccataagaaccagaagggctaatcaagagcaagcatatacctatttatactttttaatttaccttttaaaataaccctattgaaataatgtacataccatgaaatacacttgtttaaagtgcacaattcaatgggttttaggaggtctatagagttatgtgacaatcgccatgatctaatttttatcatccccaaaagaaaccccatattcattaacagttacccccattccatccttctttacttccccctctaccactcacagtcctaggtatccattgataaactgataaatggttacctaggactttctttctctattgatttgcctcttctggactattactataaatggaaccatatattatgttgtgttttatgacggacttttacttagcataatattttcaaggtttgtctatgttatatataacatgtatcagcaattcctttttattgctgagtagtattgcattgtatggatataccacattttgtttatccatacatcagttgatggacatttgcactcttcccactttttggctattaaaaataatgctactacaaacatttcatacatcttcatatgtggatatgtatggtttttttctcttggatagtatcgttacactgtttttcaaagtggttgcaccgtttcacattgctatctgtaaagtatgagagttctatattctctatatccttgtgagcacttgtaaatatctgtttttttattctagccatccccatgggtgtaaagtgggatgtcataaaagtttcaatttgcagttccctcatgattaatgttgttgagtatcttttcatatgtttactgaccatttggagacatgtctattcaagtcctttgcctgttttttaattggtttgcttatccttttgctgttgaattgtaaacattctttaagtattccatatactagagtctttttttcttttgaggcagagtctcgctctgttgctcaggctggagtgcagtggagtgatctcagatcactgcaacctccacctcccaggttcaagatattctcctgcctcagcctcccgagtagctgagattacatgtgcttgccaccacacccagctattttttatatttttttttttagtagagatggggtttcaccatgttggccaggctggtatcgaactcctgacctcaagtgatccacccaccctggcctcccaaagtactgggattgcaggcgtgagccactgtgcccggcccatatactagactctcatcagaatatgatttgcaaatattttctcctattctgtatgttgtattttcacttccttgatagtttcccttggtgccccaaatttttaatttttgatgaagcctaatttatcttttttttccttttcttgccttatatttgggtgtcaaatatcagaattcattgctatattcaaggtcatcaagatttatccctatgtttacttccaagaattttattgttttagctattacatttaggtgtttgatcaattttgagttaattttgtatatggtgtgaaatttggactccaaccttattgttttgcataggtatatccgcttgtcccagcaccatttgttgaaaagactgttttttccctattgaatggtataacaccattgaccatagatgtatgggtttatttgccaactcccaattttattccattgatctatatgtctctccttatgttatttagtaccatactgctttgattactgtaacttgcagtaagctttgaaattggaaagtgtgagttctccaacttagattttctttttcaacattgtttggctattaggagcttcttaagattccacgtgaaatataggatcaacttttccatttcttcaataaaaggccattgggattttaatagggattgcattgaatctatggagacaattttggaccgtattgctatttcaacaatgttaaatctacctatctatgaacaggaaaactttttccatttatttgggtcttctttaatttctttcatcaatgttttggtgtacaatttagagtgctcttgaaggcgaatatgtatactccataaaactatacagtaattttgttacctttttgtgggcatcaaattgtaaccaagtagcttccccaaaaatatactgtctgtgctcttaaattgtggttatggcattttttatgacaaatacaaatacttgagtgttcttgttaactgtggcatcgttacttttttgtgttttatcattatagtccaacatgaagaaacaacatatattgcaattgctttgaaatcatcaattcacctttatgcatgggcaccaaagtcctttgatgaaagcactgctattaaagtgagtgagctcctttttctttggattatatgattttttattttgagaagaaattgtgaacagaatcgtaccttggaatacagatgcagaagtatataccattcttctatagttaatgaaattttgttgttagtttgcttgcttgtttgtttgtttattttttagatacagggtctcactctctcactctggcccaggctagagtgcagtggcatgatcatagctcactgcaaccttgatctcctgggctcaagccatcctcccacctcagcctcccaagtagctaggactacaggcatacatcacacctggttaattttttaatattttgtagagatggggtctcactaatgtaacttgaatataccatgtcagtaattactgtttaacccttttttagacaattcacaggcatcacagcaagggagaatgcgagggaaatccctggcccctccccttataggacctccccaccagcgcctcactcccaattcctgtagtcaatatgaagaccttctctttcagagcctcaaacacaggctttgggtgccaccccaataaattgaagctgagaaagtccctgttttctcttagtgggggatagagagcagagggaaggtaaagaaaggtatggtaatgatagagggggaacacccttggaggaaaaaggagggaaaagaaagcctttgctccagttaccatggccacaatatgtgggtatgggaaggggttggatgagtctatattctttccaagctggaactctaaacacatttctctctctatctattaatattgtgagacatggtggttaggcttaccagtactctttctaactttattacagtttggctgaacttctatggataggccacataaataaacaattgagtgtcttaaacaactaaccttaaaatgagggactgtttttatctagagtaacttacttataatgctccagaattctacttaaatggaattattttgtatttattccatagtaatgagggttgactaaagaactggcagcattctatcatgtccagtagcttctaacctaggatgtatatcagaattagctggaacatttggtaaaggtttagatctcagacccaacaccaggctgaattagtgggtctggagtagggtctgggaattgatatttttagcagatgttccaggtgatttttaactagttgatccatagacaggttttaacaaagcactgatagggacccatcctgacagacgcagcaaggtattcatgaaatacttttgtatcttaagtcaggatctgtttacatggtatattttgtaagggaacacatcacatgtatacaataaagatgagcaaattcttatgactacctgccaatgtctatttgcataataactatgttcttctataaattatacagatgactgtatatacagtctgagtcaaccctaagacaaatcacgtcacatccctgatctgatctccctaaattgggccttggttcagctgtcagtatttggatatgggtttattcttgggtgtctgctgattggtcagagctgcctggtatggagctggaaagcgaagaaataagtaccaacagtctgtctagcctgatacacagttcttgtccaagtcctcactgcagttcttgactcccacctcacaactacagtatgttgaatcctgtgatgctcagtcctctaccgtgatctgatcttggcaatgaatcctgtttggccttttgttttggactagaaaccataggagcctagagtacatacccagtatatggtaggttaacatgtctggcccttttcattccctaccaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggcaaggaacttgaagacagcaaacagaatgcagggtcatacaaggctcttatgatcattgccaatctgacctttgaagagaaactcaatattttgaagctattgaacataattatttctttgttgtaataacaggtctaagaaaaactgtaatacacaggtctctaaatacaatatgccattttaaaaatccacctgggttttgtacacttataaacctgacaaaagagtgagggaatttttgccttagttagaatgtcatttttggccttttggccatatttggttttatattcacaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatgtaagataacaccttcagattcctagaaattattgtataccaccatttgagtttttccaactgtcaaaactctgaaaggtttaaaaatatgattagtaatgtctataccggaactgagacataaaaggtaagtatagagtgccagaaagtggtcttgcataaacaaaaaacactgatgattccttagtttagaaagctgagtatattctgcagatagattttgcttgtcttgcctaatttttttttatttttaatgaataaagtttacacttaaactctggacttctattgctacatcagaagaccagatagcatcagtgccacattactatctagccattatcaattggaatgtattcattcatagctccttttagatgggatatgtgctctacattctctacccatttatgtttatatatttataataactgaccataaagtgtatttgattttgcagtacttgctttagtttttctgcacttcacaatgcattaacaaatttttaaaaaatacaacaccagtattgcagcattattatgtgtattcctattctttattatattacctcaacagtgacataacagcaaattatcataaaatgttctcttatctggttaattatagttagaatttctgatcaaaagattcagcattttaaaagcagatactcctcaactcttaaatgcttatattttgtgaaatacggtgcaacacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaagaaatacggtgcaacatctaaaatatagattgtcataaaaatattatacacatcatttacataaagagtttgaacataatgtaatatccctcacacacaccatacaaaatataattctactgtgtctcaaatttgatgttggcaatgatgtttgtcctattgaaatttttatttaaaaggaaggcctaaaccaacagttctctgcttcactatatttaaattcccaatttttagacaaccaaagttttagcagtttagcattatacaaaaagtccaggagaaaactttgatgtattttcaaattactacagttgtgtgatattttgaacagctctcagaattgtctcatatgtctctaacaaattacataaaccaattgtcaggacattagtggggacaattttgtaaaactcttttggtcatattaaagataattagcttattactcagttgttgcccatgattatatagaaatcacactgttgataatgtataaaatactgaaccaatcttagccaaagccacttaaacgtgaggtcaagttaattttgatatagctattgttgtactcttcagttggagtgtcttccgtagcttcctgcatctctcttttttttttaaatgttgcgtcagatagcttttattaagaagctagtgcagtattgaactttgcagcattggtccatgtttacacttatttgaaaagtaattcaggaatgttgacccgcgtgtttcacatgattaataagcaaggaaagttatttccttttgaagcaatttgttagttagagatgagttcttaaaaatcactttctgacccaattaggataccttgtgtatattcaaaaatatttttagctaaatactctagtgtcttgacccatttaaagagaaaggactctaatatcagggaggggggtgtcttctgagaaagaatataataaaaatactatttttccaagagtgctagattacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttggcaagtatagtttctgacttttttttttttttaatgtgctagtttgaagaaaccatagaggaacacaatttttcatttgtagggaaatactgttaatgtgacaatatctgtagtttaagaaaactttattgcattgttttatgcatcatgaaatttagaaatgcttagatatttcttagtttttcatattatgtcaccaaatatgtctttgaatgtgtatcttaagtgcatttgaaattatattaattggaaaagaaattctaacttttttgcaaagggggaaatgacttaaagttatatttcaagctgtgaagactattataaagctgtcccttgtaaacattttaagcttaagctattttttagattagttttctatttctaatttgagtgagttggctgataagcaagtattgtatatttgttatttgatttgtacattaattactaaagtatttattaatgtgttatcttaaacccaagtctataacaagtagtgtttcttctattatgatacataataatttgtgaaatgtcaagaaatctctttgtgttggaaatacatctttgcttttttaaaataaggctttctcctaattataaagaagaatatttaacagttatgaatttatgacataaagaaagcagctctcttcaaatattggatagcatgcttattactttggaaatagaggtttctcttcctccttgctctttgaacctcttttggtctttattgctctgccaagctgcttcgattaaagtagtagtgataaaatattggacatataaatctttatgaaacataattccagcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctataggtatgtatacaatttatttcttcttcaggaccccagagaaaatttacaagggtaaaaaagtgtcctaagaaaagatttcctgaattattacattttcttaagacacataagattagtttggggttctgcataattattctcttagtaaggtgatgcctgtatttgtcctatgcttaatgaattcgtgagagtaccacaaagagactcattttggttatctgagttatttgcaatattgtataactgaaatgagagctaattcctttccacaaaaatctataattttgttttaactccctttacttgcagactttacacagatattggaaatgcttcttttcatcacactgattgtggggtttatctttatcttaggagactgccaactagtataaaagagccaaatacttctattttttatagtcagtagagttctattttgtgagtgatattcctgtgaagaatcaaatcatttagaaaagtgacagatatgactgactggagtgcttgttaggtaccaaccacgtggcaacaaagaaaaatgccttttcaccttcatcaaaccaggatatttttttcttcctagccaaagcaggactgctgatctgagaaatccaaataatttgagattcttgtatatgttctgaggctcagtgaccccagacgtgattctagatagggaacataatgcatacaaaaagtaaatatattagagagagtagaatgattagctggaggatagctattatagaaaagagaagtttaatggagaaaataaaggaaaaaggcagcagtgtgtgtgtgtgtgtgtgtgtgtgtgtgtgtgtgtgtgtgtgtgtgtgtggagagagagagagagagacttaacaattgcatcagatattactaagtgttcccatttccaaaacattgtgtcccatctcagaaagcaagctagctcagtagctaggttaagtggcagatgtaggtgttttgggactaaggtggaaattatgcgatgtcatatgaactatgtacttggactcagcaaaaagcctttgctttaggtttagaatttttagtctatgttgttgttgacaacatagagacagagagagagagagagagagagagatggtctgtcaaatgagaaggcagatgcttctgagatctctataaaatgactaaatatgatcctcatgtggctttaaggaccattttgaaagaactgctttttaatgaacattttttatatgggatgatggcactttgcattgcatctgcagaatccttcttctttttttttttttcatatatagtcagtttaaggattgtcctgaaaacctgctccaatttcctcaaacaagtaagaactcacagaggttttaaaaccactttaagtgacagaagataaatgcttacagtataattgacagattcggggcaaaagaaagtaaaaataatgactcatgttctatcctttacagtggtacttttgtgatcgatatgctaatcagaaatggttataaggaaattcagttcaaataggaaactgaacaaacccttatatttatgccagtagacaatcataagggtcaaagggatcttgagaagtcatctggtgcagctcttgtcctcagacaggacaacttctgacctaaaacaaaaaaaagctactttaagttgctagaatttgaaagacagctacacgtaaaataaattacagtactataagaacatgatactttagtttgtatattaaggatattttgagagtatgctaaagactgtcatataacactgatattaaggagatcaattactgtattattctgtctacaaacaactgctttgttatttaaaactaattcagatccagatttccccaatttaaattttatgttttcttaagttataataaatgtgttcaaatcattgctctccatttccaaacaaatatgtacaggcttaacaattgcatcaggtattactaagtgttcccacttccaaatcattgtgtttcatctcagaaagcaagctagctcagtagctaggttaagtggcagatgtaggtgttttgggactacggtggaaattatgcgatgccatatgaactatgtacttggactcagcaaaaagcctgtgctttaagtttagaatttttgatctatgttgttgttgacaaaaatatcatttttaataaagtagtcacataggtgaagaaattcaactctagatagactagatctgttacttgttcccaaccctctggagactgattttccttatttcccttatatctggagttattttaattctagtctgaaatttgacttataaagtcttcttccaggataaccatttttcttagtcaacttattccttttataatagaaaaaatgaaaaatcaaagtaattaattgaattctgattttaatcatgttaatatgagaatgaagatgccttattttgttgtttcctagactattttaatttgagtttaaaatcttgatattattttaaatgtcaggattttatttacttatggaatttttccccatgaagtacataaagaatattaaattgaaagttaaaaatgtaataatagtgctgttccttgtgtcaaaaaataccttgcagcaccagctgactgactgtttacacaattaggtttaaggcaattattgtcataatctatatttgtcacaaagtattataaaatagagtcaaaaaagttaaaatcttaataaatatttcctgagcaggaaaaaaccttaagaatatcaaattagctttggttctgcttacaacatgataatttattgaattgcattagggttgctacagtcattatttgagcaagtcattttttaactattttaatttttgagagtcaggttttcatgtacgtcactggagcacaaatatacacccttattaggagcccttattaggaatgctgtatgtcacttagactataaaatgaagagtggctgtgagtagatcacaatgtctacaaatgggatagaattagttcttagctttttctatggtcttagaggatatgaatacaagaattaaataactgagacctggtaattaaatgttgattacaatggtgcctttagatagccagtttgaacaccactcttgagcagcaaaatggccaaacaactgactacaggagggaaaaacaggatgtgctaacctgaactgtaacaatgagcctcttaataaacaaacattgactgtagttataattttctatgatggccagaaagattttgtgtttttctgattttttttcatttgtattgtagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaaggtatagcttacaccctccagttacagcaaaaataacgcaaccattgaaaatgaaccaacaaaagaaatttctgtccttttccttctggctataaatatatttgtggtatattttttcaaactggcatactattgattaaaaaacaattttatattttgcagtagaaacgctaatttggtaagtgatgaaatttggtttcaaaagaagctcattttgaaaaaaataagaaaaaattctagttatgtcttaagcaaagcttagccattattttatttggttcgaaatcctttattgtctttgattcatagtacctttcatgttcatattaaaatgatatttttaaacaaaatgcttgagcaaatctgccttttatagctttcaacataattcaataacagaaggaaaatgtacttatgtttactgagcacttaattgtatagtaggccttgtgctagatactttaacagctatctcaattgatcttcacaagtgggtgttatgatgtttattttgcagaaaataaaaataaaatcaagatctggcaattatttgtataatttgatcaattttaacaactaattcaaatagtttagatggaaaatttcatggtgtaagattattaccattcctacctattataggaaataatagtgtgaagaaatagtcctaataggattaggaaacattcatgttgagaagagattgcagagggtttgagttaatatcagaacagccagggtaaagcactgtatgtcaagcaaagttgccaacttacaatgtgaagagatgaaatggcaaaaacctgtgtttcaggtcagcgagacctagaatgcagtcctggctctaaccaggactaaccaggttagagaacctgagaagtttgattaatctttctgatccttagttccttcatctccaaaatagaaatattaataactgctttgggaacaattgtgacaactagtcatatctgtaagcatctcacagattgcctgtaacatcagatatgttaagtcaagaatgactagcatatcttttaaaaaaattacaatgttgtctctttattatgaggtaaaatacttactatgaaatgtaaaatgctgttttcatatacacttaaagccctgcatccccctctgtatagagcaaactctgtaaaggtttatgaagatttttatttaattgggtataaagcagatcttagaagagttaagcgagggcattttaaattttatttaactcagtataatcatataattttttcttaaaagattatttgttttcttgatgactactaaccgaagtaactatgattgctgcctttgtctaataatattaaatatttttaatatttaaattttaataatttcaaatattatcttttatcaagcaaaatgtacagttacatacactgtaagctcacagtatcacaaattagagactccctgcttccctttgtcacacctagtgtatcttatcatcatcattatgtcacaaaatctcctaaatatagccactgtggatgtcaaaagccttagtcctaacaaggagacatttgtttgatatttatgtgcatattttgttataattttctttatggtacagaccacatttacacaacatgtccctctctaagccactgggtttaactcattttatcaatctattgatgtccattttgctgagatagaaaattgcatgagtggatgttaagtgctctcaccataaaaatgataaccacatgaggtgatacatttgttaattaacaagatttaacaattccacagtgtatatggacttcaaaacatcattttgtttgtgataaaaacatacagtattatctgtctgttaaattttttaatattaaaaaataatgaaaagaaaaaaaaagaaaattgtaccaagtagaaaatttcaatggcttcttaaatataagcagcaatggtaaacaacacctaaataatttgtttccttatattaaaagaaaagccaactggaatataagtagattattgttttaaaaagcaaagaattattgcccaaaaataatcaagaacttcagcaaatgaaggccacctacgaaattactaattttatttaaccatataaattataattatgtagactatagtaaaagggttgttttaaaaatgtataaattagacttcaaactaaagtaaactcattctttcatttgaaaaacaaactattccacaaaacagtaaggcttaatatcttaattagcagatgcagataaaattatagttatatgaaatatctggttgcaatgtattaaatatctgttgacagtgtatttctttctttttcaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaaca

SEQ ID NO: 897 - DNA, 136082 bp, mus musculus
cctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttgaagaaataaaaccaaatgaagaggtgaagagacatcttaatcacttgtgttgaagtttgcattttgatgcaaagtagagttgataaagcaagtaaagaaaccttcatatgatggtatcccttgcagtaattatcctcaataggacatatgtggaggtcagaaaattgccatctgtaaacaccaagtataccaatttggcaacagccagacaatgagggaagattcaaacattggagttgcaaactgagaaaaaacattcagaatgtggaagaataaataaatatgactctagtttaagattgatacattatgtcctttgcaggcctagccagctaaatgaccacaagacaaagacccttgagggaggatagacttgctttacaaattgagaattgaagaaattggtaggttatttggtatttttgttattagatagatattatttttaaacctaaaagagtaaacaggaatgaaagctaggaaacaagaaacggtgacaaaattatataactttcaacattaaaacattcacttttatacaatgatataactttttcacgtaatgcactaaaatcagagacaaaataagagagccaatgtaattacaatagatcaattccattatgtttgttaattaatgggttactgtaattttctgattttctattgaataaatattttctataggtgaaaaaacaaaaaaggaagtgcagagatttgtggtttgtgtttcctttctgaaaagagaagtacaaagctttatgtctttatatatatctttgtaatatatgtgtgtatgtatattcaccttgcccaccagcaatacctagggatgtgcgtgtatgcctctctgtctccgtctctctctctctctctctatatatatatatatacacatacacacacacacatatatacatatatatgtttgggtgatatatatatatatggtaagatatatatatgattatatatatatggtaagatatatatatgatcatatatatgtgataatatattatcatatatataataatatgtgataatatattatcatatataatatatatgataatatatatttcatatataatatatatgaaatatatattatcatatatataatagataatatatatttcatatatataatagataatatatagtatatacattatatataatatattatatatattatcatatatataatatatatataatatatatatattcctagtatgcctgtgtccttgagactggaaactatttcttcctctccaaatctgtcatgtctttcactatgactatcccctttgccttctgtgcccagtatggtaatgacattcctcacggctgtggccttggtatttgacactgccatgtgcagtcctaatctatattggggtcaggattagacaggccttgaggggacagtagtggcagaggttatctgaaatagcacatgatccaaaaactatatttgaaatacattaggcttatatttaaatataactgccagctctacccagaccaggcctgctatccacatttggtcatgagaaatttcccactttaccaagttccttagccccctgttcagaagcagttttaccttcatttcagttaactataattgaaatattcagcataatcctcaattacatatatatagagcatcacctctgcataacactgcacatcagtttattttctcagtcttttttccagtttctagagcaatggttttcatatggtagtgcacaagaacagcgcacaaaaatcaagaataatttggagattttgggacccatgatcaaaaattctgatatcgtaattccaaggaatctgtatttttaacagtattacccagatgattctcacgtagcgagagtctatacagtctacagtttgagaaacactgggctggatgaagagatttcccctttaatgccaccatgtaaattgtgaagcccattcctctgactatctctgaaactcactcaggcactcatcttgccatatccatccctttcatgttctctctccataaactcttttcataaaattgctgtttctaatattacaaataaaaggaggaaagcctctgctgtctccttcaaggtactgtgcagtctccttctttttgcagcctgactgctggagcgtgtttcctcactctcctttactatcctaaatttgaaatttcttgctactcatgttgaccatttttggttcctttttctccttagtctctgccatatttggttctgtggatcagcttctgctttgaaattctctcccttgaccagttaacactgctttctattggctcttttccttccagttactcccatccctggcttttattaaaattagccatcaagatggtctttcttccctgcccttgaattcaggagacagaaacgactccccagaatttgagatttcagtgggcagccagactaggacttttaaactgcaggagataatttagatgcatagaaagagataacgaaagtacaacaggtttgtctaacagtttatggttcaaaaatgttttaagacttagatttttagtaatttattgtaagacaaactagaaattagtttcttctttactgaccattttgtatacccaaatgggacatcaagacataccaaacccccaaataatctccaaattggtatagcagtcatagatacgaacatctaccttctggttttcttatctcaaggtggcagggcagaggaaaggaccaaataattatggaaacccctctgacgtggaacttctattttcacagtgaccaaaaagattgttcctttccaattcttccttccttggaaacccagaataaacttgctctgactgtaagtgcaaaatatatgaggaatttggcgttgttaacctagtattaagcatagtccttctcctcttttccccaatttaacgtttagtcttgaaagagagtagcatggagatggggaacaaaaatagcatatagaactaaagaaaacaatatagtcttagaatatatgaatactaagttgagctgcctttaagaggaaatttttaaaatgttcttttattaaacatgagtatgaaagatggtttggtcattcgagagcagaaatcaagtttcccaacatagatatgaggcctccatgaattttgacgggcattttattctagtccatttccttggtgtcttttttgaataattaggtaactgtattcaaatcagggtaaagtatttatgttattgaggactagagaaaggaataaagaaatttaagactgtgctcaaagattcaaaaataaagcttgtacagatgttacaataattctctaatatatggtatcttttccagctaaaatgcagccttaactatagcaaagaatagtttaccaataggaatcagctaacatgtttgattattttgacagatggccaaagactgtttctccagaattaacaatgtctaaaataaatccctcaatgatatccatcacataaatatgctacagtgataaagtcttcaagtcagtccctagtaacttttttgttggcttttctctcataaatctttcaatgagttataacaaaagtgatatgcttaataataagggtaatataatgatctatttttacttcttagatcctaaaaattatcattttagataaattacatgttcgttgggagtatatttctggaactatttctttgaaatgataactgtgtattgtgatcttaactttgatgatcattttgaaaaactaagctgctaggctgctgctttatctaacaatgcttttatcaattcagtggaaacatctagattttagaatgactgatagactatgatttttatctgtagaattttagagctgggagatcacctatcacaagacttttattttatgtatgtgaaaactgaatcccagagagagtaaataacttacccagagtcatatagttaattaatggtagagctggggctaaaattcaagtcttctgactctctgtccagttgaatacttattgaatgatgtaatcccaaagctgtgtcattttcctatgacagttttgctagattacacaaatatcacggcagttttaaggagtttataatttcattcatctaagttgcatatgctcaatagttttcctgtttagcttatatttatcacagcaataaaaatgttttcaaacaggattaaacaacgtttgtgtatataaaataaactttcaataaggtatgtgaatttccaagaatttgccaatgttcttaccactttgtgtataaattggcatctactcatgccttatataagttttgctaaaatagcaaaataggctgctagactaaaagttcaaacagtgataaaattcaagaaaccatattttgtggtgaacaatcaaggagtacccatatttaaaggtaagaaaacaatacttgaagataaatatggaagcctcataactctatcccaaaacatgttatgttttgtttcctatgatgccacatttagggttaagccacagaaaacgtcactttgtgccatgaacaggtatttagcagatgcaaagtttaacttttaaaaaattgtctaattttcttaaaatgatgctcttttaatatcatgatcttgctttgttattcatatttagtgatggtatttcttttttaagagctgttacaggttggtgcaaaagtaattacggttttgccactattctaatgccaaaaccgcagttacttttgcatcaacctataattcaaataagtaatctaaactttgtatccaacatctagtcatcattgttgcatgttaaattttctgcttgtctagttatcactcaaaagaataacatcggctgggcgcagtggctcatgcctgtaatcccagcactttggaaagctgaggcgggtggatcacgaggtcaggagttcaagaccagcctgaccaacatgaagaaaccccgtctctgctaaaaatacaaaataagctcagctactcgggaggctgaggcaggacaatcacttgaattcgggaggcagaggttgcagtgagccaagatcacgccattgcactccagcctgggcaacaagagtgaaactccgtcgcaaaaaaaaaaaaaaaaaaaaaaaaaaaaaaagaagaagaatattaaaagagtacttccattgcaaataaatgaacttatttctattttatctttctaattacatcattaatatgcctcagccttacataattgtgtgcattttacagttttatgataaataattacacgactacttaatgtccatactgcttattcttttttatgaatgagtatagtcagttcaaggagattgtgacatgtctattattttggtaaatgacatttaggttcttcccatgtaaattttaacagaacaaggcagattggaaataccacttaagatagttgaatgcagccataaaaaaggtagagttcatgtcctttgtagggacatggatgaagctggacaccatcattctcagcaaactatcacaaggacaaaaagccaaatgccacatgttttcactcataggtgggaattgaacaatgagaacacttggacacaggaaggggaacatcacacactggggactgttgtgtagggggaggggggagggataacattaggagatatacctaatgtaaatgacgagttaatgggtgcagcacaccaacatggcacatgtatacatatgtaacaaatctgcacgttgtgcacatgtaccctagaacttaaagtatatatattaaaaaaaagatagttgaatgctcacctaatttcctaagaagattaacaatttttattttacttttttgcaggatccaactggaatattctcactagataaaaccattggccttggtacttatggcagaatctatttggtaagttgacttacattatttattcattcttcattttctaatgacaacaaagattgtgagtcagacactgcaaatcacataatgccaaaatatggcatttcactttgagagagaaatcaaattagatagcccagtgacacctgtaagaattactgtttattatcacaaaagtaatggattggctaatctatagtgtaccaaccaaccaaacataacatctaaaaattagcagaaaataaagtcaccaatggaaaattgaagtaattcaaataagatatacccaaataagatatcacttgtcttatagtatacatccataccattctaaatactcacattcaactgaaaactgaatgttattaaaaggaatgttttcataacattctatatcatactgtgtacttgagtgtgcacatgtgtgataaaattttctaaagaatctaacaagaaaaaatctgaatttatttagtgattacttatggtaaacactaagtatgtgcagatgctgtgatagtctctgggaataaaatgatgaacaaagcagataaagtcccttctcttttggggcttatggttgagaaatgtatgtgagtaagtatgtatatgttatatgtgttgggtttgttgggggagccatacattacataagtaagcacacaaataactgtatacttctgtatctgtgcgttccacatccatggattcaaccaacattgtatcaaaaattaaaaaaatgcgtaatgtacagacttttgttcttgtcattattccctaaccaataaagtgtaacaactatttatatagcatttacattgaattaaatgttataagtaatctagtcatcacttaaattatactggaggatatgcgtaagttatatgcaaaaaaaaattactgtgccattatatatcagggacttgagcatgccctgattttagtgttcacgggaggccctgaaaccagtcccccacagatactgaaggatgactgtaattgcaactgtaatataagatctgtaagaaaattcttagtgatgtaaaagcataaagcaagggggcttaatttagattgaaatgtcagtgttgatctcccactccctggaaagggaaagtgaccgttaaactgatatcagaaggataaatatgaggtaaccaagaaaaggtgtggttgtggaggatgatgttaatacattctaggtggaggcatggacagtgttaagggctggtttggggatggggtgctttagtagccatatcacactgatcaggtacctttctattctctaatatggggaactgacattttctcaatcttgtgtaatgttctatataattgcagtgttctttttccccaggcctgttgctcaaaaaccggattactgtccttaggctgatccttacagcagactgatcacaggtcctccacatataggttgtatagaggtgtcctagtataagcccagaggagaaggggcttctttctagttcagaaaagggtgccttttttcttgccaagtcttgcaactttgggactacatctacccagaggggcttcttttcttattcatctgcccaggtgggaaaggagtatgctttttaaactttgcacaacagctcctatagggcctggtgctgtggctcactcctgtaatcccaatactttgagagatgaaggcaggaggattgcttgaagccagagttgagatgatcctgggcaacaaaacaagaccccagctctacaaaaaattaaaaagaaaaagttagccaggtgcagtgggtgtgcacctgtagtcttagctactcaggagtctaaggcagaaggatcacttgagcccaggtgcttgagactgcagtggattatgtttacaccactgccctccagtttgggtgacagagcaagaccttatcgcttaaaaaataaaaataataaaataataaactaaataaagcacccatagcatagaaactgagtagtagaaatagcatgtggacaggtcttaaaaacagaaagaaccttggtgaatatagggaacagagggaatgctagtattcatgaccaaatgttttcaaaccattttgatcatatctattaacagaaccaataagctatagagggtgatataatatagactgaaatatattgcttaggctacctcaattccatcctgtactgaatgattatttaatatttgtgcgatctaggtcagttttgccaccttatacatagatacctacatcttatacatagatacctacatcttatacatagacaaaatatttatggtacatttacagtctccatggctgtatgcacattttagttccttagggtgtgtgtgtaagtgtgtgtatatacttgttctgattcaaatgtatagagccaccagatgtgagaaataaaagctcagagtcatataaggtaagaagcaaggttaaaattagacaacacagaaagatggctactcattatcattcatgtgataatgaactgtgatggcaccaaaagaagaaaagtaagacggtaaaaaggtaagttatgcatgtgaatatccttttttaaaatcagggtttattgggatataatatatatttggtaagattaactcttttaagtgtacaactttatgagtttggacaaatgcatacagtcatataactgccaccacaatcaagattttcaatgtacatcttaaactaatcacagtctagattcaaggagtattctacctcttcactgtgtggtttcccaactggtgtactctagggttatggctgtcaggcattttgcttttacatatgctacaaacccacaaaactactgtactttccctatacttactcttttccctgttttcactactactatttttaaaatttagctaatcaattatcttttacagcaattaaaagtcagaaagagtcttttatgtttatcttcattttaaccatttctggaatcttcatttctttagtgtagatccaactttccctctggtgtgtacaacttaagcctgaaaaacttcctctaatatttcttatagtccaaggcttctgagtaatgaattatctgcttttgtgtgaaaagtcttaatttctccttcatttttgaaagatattcacactgtgtataaaatgtggattgagagttattatttttttctttctctcagcagtttaaacatgccaatttgtcttcagacttgcatagtttctgaagtctgctgtaattcttacctttgctcctttatattttgtctctggcttcctttaagatttttctctttgtctttgtttttcagcagtttaaatatgaaatgtctggaggtgtgtgcgtgtgtgtgtgtgtgtgtgtgttgaaaggatatttatctgagataatggttagagatctttggggttctcttagcttcctggacatgtggtttgacatatttcattatttgggagaaatttttggcctttatcttttcaaatattttttctactctatttgctttcttcttcttttggaaatccaatttcatatgtgttaggccttttgatattatccctcagttcttaaatgttctgttttggagtgtgtctgtgtgtgtttcattcttttttttctctttgtgtttcagttttgatcaattttttttctatcttcactttcattgattcctttctcagctgtttcaagtctacttatgagagagtcaaggacattcttcaactatattactgtttttcatttctagcatttctacctgactctttaatagttaacatgtgtactgaaatcccctatttgtttattcatgtttttcatatttttcactaaagcatttcatgcattaatcatagttatgttaaattctctgtctgatggattcaacatctaagtcatctctgagaggctggttatgttgattgctttgtctcttgagaatgttttttattttactttatttcacaatttttgtttaaatgacatagtatgtagaacagtagaaattaaagtaaatagtatttatttcttgaaatgggcacactttttcagctaggttgtttatatgggaattcactcaatctaataagaagataaactacatttgagttatgttgttgatatggttactctcagttcactaccagcttcagattcctctaataccttgtgcatatgtgggggttggtcttctggagagtttttcttaatatccctgttcttttctcaactttccatattccttgtgtatctgtgcttcaaagaggttcttgctccatgctgttgccctcccctaatggtatactgctattgcttcttattaagttctcattggcctggtggtgtgggcaggtagaaatgctctgtttttctgcttcaacctcagtcttgtaagatcctgggcctctgtgtcacaggagtgagactttcttagttatcctttccctcttctagtggtaggatacttctaattgtttgggcccacaactaattcttgcccttctcccaaaattggaggactttttttttttttttacctttccccagctgcagtaggtcttcatctttaccctggggagaatacactttgctgcctttcccctagggcttaagacttttattcatgaaaaggaaaggaactggacctggtttcctacctttcccactgcagtggcttctcatctccatcagatctgtaccataaatctgtatgtttgtataaatttgtcctgtgtctatggcttccaagggttctatactctcatgctaacccacatttgctctttagcagttcactaaaaatttgcatgcttgcaaccaaaatatctcatgcacctcataaatatatacacctattatgtgcccacaaaaattaaaaaacaaagaaaaatttagttgaattctttatacctgcttccgttgtgaccttgtcttccctctacagccacaggtgagctaatgctcatgtcccatctctttttgcaggtgcttgtctttctccagacctcagcctagttggttgccttgagacttctctatagattgaagaaaagttacgattagctagattattcagcttattcttgttgttagggtggatgtggcacactttccaactttcacatcctcatcaaaagcaaaaagtccatgttaattccttttaactgactcttcatgaagaatataccatatgctagatcctcctgtacacatttataaatcctaagaattttctgtgtacctactcagatccagagatagagaacaatttctaacatcagatcttccaagtacaaacttccttgttacagaaggtagatgcttaaaaaaacttcatttacaccagaatgatttccgtctgtcactcattgactttacctctttttttctacctctaattactataaaaatatttgggatggtggtgctatccactgacaataccctcatggaaaacaatctgggagtatgtaaataaacacttaaaaatgtttatcctctttacaccaataattcaacttttggaaatatatgataaacatcccagacatagacaaacatgtagatatacattgcagaagaaaagtagcatattgtggtgaaaaaagggcgtgctttgaaccaggcagacctgattcagtgcttacttagccattaactagctataaccttgagcaagtcacttaacctaagtttaagtttccttatttataaaatggggctaataatacctaccttgggaggtgctataaaatatcaaaacaatatacatatatgtacacatttgtaatatttggaatatggtaaatacctgttaaacggcagttattgccatcattattgttgctattattttttaaaagttcaattacaatagtttaaaaagatggaagtaaattactttttaaccagctaatatatcattgtcctataaagcaatatttatgaagttatctagcagcatagaactatgtttaagatcttaagtaaagtattccttattatatttgtgccccagttacagctatgttaaaatatgcagataaaaaatggtgaattaacgattagaatagtgagatattggattttttcttttctaatgtctgtaatataatatttaagtacagaacatatatatctgtacgtatatttaacatattatatatatgtgtgtattagacagtaccaaatgttgcataaataacctgtactgcaaaatagaagcatgataccattcaaaattaatgtcagagtgactcatagagtcctttgctttttcagtgctgccaaccacatcccctgctggagtttgttttggttaaagtctctccaatgtcttccagcttgtttccaaggcttcgttccctggcaggtttccagctgtctgctgaagtctgtgcacattgaaatgaaggctgagtctcacactactattgtaatcctcttcctttccttctttttcctctaattagatgcctatcctctcaccctctcccacctcctgccagttcaagcctcacttgaaattgtgggttctatttttctctctttttaggagagaaagtactggtcttctcttttttgccccagtagagttagagaatatagttttctcctcacctttaactgctagtctcatagtttatgggtcgtcattttaattggaggaatgtttagtatttgaccatgtgaggccatattagaaaaaagaaaataggttggaactcatttttaatggtactttttaaaaaaagtaatttccccaagagcaatagacacagaaagaccacagtattaagaaagagaccaagacctttagggtggcaaaattggaggtggcaacctgactctcccagtaactgacagtaaacgtgtttcttgactttctgggcccatttcttcaacaataaaacaaatgtattagactctataatctccaggctttcttctggctctgagatattgcacctagcacagtgcctggcactcagtaaaatgtaacctattcttattcttactgtcatcagcataattatagtgatcctattgtcgcttctccaccttacacagtagaagttgattattggctattagctggagtagtttcactttttaccaaataaaattatttttaacatgtttttctattcttttcttctgttttaccacctgatagtgagacctgatttttagctcagtaactaataagacactcaatgtgaatgtaaaactgggtagctggtatattgggaaggtaggaatgcttcattatatatgttatctaacaccattttgttaaggttaatactagtgaggtgagacaatgaattggtatccagaatgaatgagtttgccttggcccttcatgaggtcttgactacacccctaatatcagtcacctactcctacgttaccatttgcaggtggtgaggacagaaaaaggaatgggaaaggattcaaggcaaccatttcaagcaaaggaaaaattcacctgaaatagagtaaacttctacagttgggcatacagcctaattgccatgtacgctgatgcctagttgaaactcagttaaatgctggtggaagaaagggaccaccccaagtttcttattgttttaacacctaaaaacagaccatggccatatgtgagcatccatccttgaaagagatcacaggagtcatctgtcttcttggtggtcagtagattaagtgaggtatatgaaggtcacagtcaggagcaaattcctgaattgtttgcactctgaaagtatacaattaaatatggaaatttcgtttcaaaacaatgcatcacccttaaatttggttttataaatcaccgcctgacacattgcttttatttgcaaacctcaccagacagttgagatttatgtttattagttatattttctggatttgaagttggtgcagggaatgggaatggaaaggaaggaaaggaatgttgtcctcaaagttgatgacatacaatttatgatattttaaattacatttcagaaacacagtgctgacatttgggttgcctagccactaggcctattggatgggggtttgagtatttttccttttaggctgaaattatactgtttatttgcctaccaaatgtctagcactgtgaatgctttctttttaggtagaaaagtttccctcacatccttgccattttgcaaatatagcttaattaagtcagccaacaaataatgcttgagcaccccttaaagcacatagcactatgcatttcattatacattgcaagtttctgaagcaggagctgaagctgaagctgagttgaggccacaggcatactaggctattgtgtcttcatagtacagtgccacaagtccagagctatgtcttggttccaccttcatcctgtgacattgtgataatgtgcctcaaaagtagggattgatatttcttaaggaaccctcaagctgctctagcatagaaaacattaaatttacctattaacattgatttgaatgtgtaaaccattctgtaataaaaatttaaaaaatacatttattgaatgcacagtatgtcccaagtatcatgttacatactagttgctagttagaatgatcagaatacattttttaggagcggtcatttttattaagttagttttagtagagataaggaaggaagtattttctgtatgaccgtgaccgctttatttgaagagggagtgatgggtaatggaaaggagtgagagagattggaaaaaatgaaaagaggaaattgggacatagtttttttgtttttgttcctgtatgtagaaagtctaatgaagcttctaaagaatgagactccaagaacaagtttttcctcaataagaaaacaggttgaatatttgcaatgggggtgaaaaaaacagcataggctaaataaattgagactcaggggaccaaattagtggaaattgctgaggcttacaggccttggagaaaaatggaatatttctatcttggccgtgacaactctccaactgtggaatagaatccaggcctctgagttgcaggctttactttttcttattatgttataccaaaattttcttttgcttcccaataaatcttgagggaggatgaagcagttggtagctgacaggtatgaaaggggaaagtaaatgtcatgggatttttgctcccaagaagtcataattatttttcacaactactctaatctgcttaatatgttcacagatatatattgggaagtaattcaaattatgtatttggtgtatttgggtaacacaaaatatattatgtcatttctgcagatgcttaatccagttgattgttataaagttgttccaggagcaggaaaaataaatttaaatatttggagacaaatacacatttctaaacaaaagccaaaactaataaattctttatagcatggtggctttggtcaaccagataaaaacatcccaattatgaaaatctttatgaaatgtaagtataaatctccatggcgaaataatgcagttccttaaaaataggcatacaaaattgcctgattgctgctaagcttatatatttaatgctatttttaatatattagtcctaggaaaatttatctgtacaatattttataaaccactttatagagtgatgagggtgggttgggcagtgttagaagtaataatgtactttttaatatatcaaaaagcaaattttgttttattttgcttttgcgtatatatatgtatgtatgtgtctgtgtgtgtgtgtatatatatatatatacatagagagagagttatataattatggtcagattttcagagtaaattctgttaaggtggttgaagtatcacaagttcttgctttagtttatcgtctagtagttgaccactaaaaactagttaactaggtcctcatcacatttcatgaaacactctttggaaaatagcacttcaacagttgttactcttgaaataagaatagtcctaacttgattttaggacttccaacattctaccatacttgtgcatctgtgtctaaggtagttgtgtgggtggtgccaaaatcgcacttggagattaatgtgctgctgtagctctctgagggtgtcaaaagaaaagtggaagctcttataattttatgatgctgaggctactctgaaggcaggcttctaaaaagcagcttatcagtaagactaaattaaaatatcaaagaatataaaaagacataaacagatttttatcctgcagttttattttttcctgcttacctacacccaggttgtaataaattcctcctctaccagagcataaagagagggaaaatgaagtgggaattttgtgttatttcaattgtagaaattatgatatgacggtagtttatgtgtaatttgtgttagaaaactaagaaagctccttttgggtttgtccttcttagccagagtccctttatgactagggaaagaaggttagattgttcagggtcccctgagggaaagaagattgattatattctaagcactgccagtaacattttgtataaatcattaactctgaagagaaaacaaaacaaaaataccaccatgatctaaaaggagaagtctaagagtcctcagagaaagacagcttttcttgactctgagaaataaaataaaataaataaaattattgagtgtttgaactgggtgagaaaaagatggagatttaaatattagtcactttagagatagtgacctcaatgttctaaaaatggataacatttactgagtgcttacagctcataagagcattatgaggtagctaccattgttttcatcatcctaccatctcacaaacgagcaaacaggattcaagaacctgagttactgaataggttcacaaagctaagatattgccttgcaaagtcaggatttaaaccaaaatttgcttggcccgaggtctgtatcttaatcataatatagtatattcagctcaacagatataaaccaaagtcaaaaaacattcaattagattagccaattgaaaaaacaatctgcccaagtgcaaaaatttacaagaaactaatgagctgaggtcggtaatgaagatctttaatgatgtgtctctccaacatatttgtttccttcatgatgggcactaagacagtctagtcttagggtctttttctggaacgtaatagatttcagaaatggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccacctaagtaactttctattctgactataaaaaggtggcactgtgtagagataaatatttccaaaggatggaaatattagccttacttttttattactttctgctgaatgagtcatttaggaagcttgaaagagtatattttttctctgggtactgtagtttgctgtagtgttattggcatggccaagtataaggatggcttcaagagagtctcataccatcaggaagatgtctagaacatgtgtaaatatttcctgacttggaggattggcagctgttagaaagaaaaacacatataaataagagcctacaaatgcccttgcttcttgtggccttctacctacaattcccagttgctgtaatggttttttttaactaccttacattttagtagatttcaaaaaaaaaattaatggcttgaaatgttaaactctaaaagctttagtaatgtttattttgcaggtcctgcactctgtgtgtgtgtgtgtgtgtgtgtgtgtgtgtgtgtgtgtgtctgtgtgtgtgtgtgtgtgtgtgtctgtgtgtctgtgtgtctgtgtgtgtgggtgctttttcagtcccatgtcctaggaaaccactgccagtctgaacagttagtcaccatatgtatatgcttgatttatgccctttcatacttaacaaaatattatactctataagagttagtggtatattcccctctgctgcactaagagcaaggaggaacatacatgagtaggaaggtgcctactaatttaaaagaagtgtgaagtagagagatgatactggtagagagcagagtctgtgtatatcccagccagtgcaatgtgaaaattggtttgactgatttcttcaccaccaccactactgcacccaccccaaaatatacagacagaattagttggttatttgatggaaattaccaaaatgtttgttggaatctggaacacatagccttactaaaatggaaaatgaatcttttacattacatccaaatgctttttgggacttctcaggcagatctgaatgtctggattcaagggaggaagattagtgaagtataactcactgtcaacctacttccctgaggcccttcagatgggatacctaggaatgaggccagaacgttccagataaacctccccccatttcctctccttttttgaatctggcagtggtatgagtgataggtgagttgcataggagagggtttacagaaatccatatggctggttaatgtatacaagaaaatttgtttaaagaaataaatagcaaagtagctattttcataattccattgaggctgagctgtaaagccttcctcactctacaaaacaggagaatttatgatttttaaataggcaaagtatctgcctctcagcagctggtgtatatagtaatgtgcttccagctccattgtaagtgctcatatcttttgagttctgttggtgttgtgaatcatcttgccatttacttgcattttatatatcattatgcacttggtagaaaactacaattcgtgaattgtattgtgaattgagttacagtaacagagatttagtgcctgaggatgtgtctctaggtttatagggaagcaaaagccatttgagtttctaatgatgccacttgccctctatttgcattgaaacatgcagaatgagatgtggacccaagcaattttacttagcctcaatcaaattttttcgttctaaaaaaagctatgagggcagggactagataatattcattgtttcttttatattccctgcagtagcactgtgctgaatcaaactttgttggttaattctatattttgtagttttccttattcaaatcttatattccagggccctgatgaccagatagaggggtgaaggaatagagcctggtaagtggggaaagagagaaataggatgcaagagaccttagaactagggttgccagatttggcaaataaaaatacaggatgccaagttaaatctgattttgatgaagaacaaatacatttttaatgtaagtatgtcccaacagcatatagttatactaaaaaaagtttacttgaaattcaaatgtaaatgggcgtgttctttactttatttgccaaccttacacagaatcaactttacccccatcacagatttgccacctgacaacgtcatgttaagaaacaagaaagaaactgactctcccacctgctgtggtgtggcagagaatcccagatcagcctatctaagaagctgccaaagggtggggaggaggtggtcttctggtcccagaacagctgctactcctccctgcttcttctggcaaatgttttgtagtgctttcagagcttcataggaatgcggctttgctggcagctgtagggatcattgactccaggtgagtaattctctcctcattgaggggctgggtcaagaaaaaaagaagagttttctccttgacatgccaaggagagcctttgcctgctcagtcccctaggctgtagaagagaatcaaggtcactctgggtttattttttcctactccataagggaaagggctcagggctggtgacttgaattgattagtcactctccggttttattatacctaatataggcccaagcccctagtgtgattgcaatcaatgtcaatcaatgatattaatttttttggtgaaagaccttatgttcttctgtttcacaggccaggctatcactggctttaatctatagatttctcacagaaagaccgtttgtgtcatttagagccccattgcatgcggtccatctctgtgatttttaagttaaattactcattttatctgtggtactgagaaatttaccttaaggaaggatatgtaggacatgaatggtcagtgtgtggagtggaattgaggcagactgccggcagaactgcttaaattcaactgtcacatcaccctgctcttaattctgttaacatagcccagagaatatactgttttttttttccattttgtaaataatgttcttcgaggataaataacaatctgcaaaggaataacacttctgtagatcctaaaaagattacaaaagaggcagcaatacactgtagatctccaggtgatgtaacattgttatttatgtcctctctgaatttgctaagagtcttagtggagacagagatagagccagaaacaacgtcaccatctctcagccctcgggaacttcatttgctgtaccttctaccatcatcaactctctttctagttcttcaggaaaattagtttctcattaaaaagtgagggagactatttgctgtaatgtatagatacaaaataaataagtcttagattctagccaattacaattcaagataactttaattaagagcttattgtataccagatactattctatatgctttataggcattaagtcatttgatcctcataggaatcccatgaggtagtttttatcaatgttattctcattttgtatatgtaactgaggcatagtgaagttaaataacttgtctaaagtcatgcagtaaatgtctgagccaggtctgtaatgagatatccctggcctgtaaagccctcacttttaactgtgccatataaaactacaggagaattgttaagttttaaaaaagcagtacatttgtacatgatatactcaaatcagtgaggaactggaaggtagttccaccaagcccccaaggaacatttataatgaggatccaatgtctacaactctcccagttccagtaccattattgttttcctccagtctgtgtcaaagagactttctaatgaaaacagagagaattaatgaattatattttcagtcatttgacaaagccaaattacatggcatgttatatggggaatattagaaactacttgaaaaaataattagcaattcatgaagtgcctgttctgaatagtaaatatttaagaaagattcaattaaattttctagtagctagctttttattacagaatcagttttatgtaaaatatttcaacagcagcatgcccagtgcacaatataggttttggaaccaaccagaacaggaataaattagacatgctattgatattgtgctacacagtttcaaaagggaaagttctctcaaaaaagctagacagttgaagcatttaaaagactaatcgctttgacaagagccctgaccaggaaggtatcagtttaggttcatggaatacattctaggtcatcagctaaaaattcatgtagagacttattttcacaagtttagagtatgcagcttccatctttctataatcatgtcatactagtcccctgccatgccacagtgggagcatgtgctttggcatcacataaatctgattttaactcatggctccatgaggtgagtgaccagggagtgagttgcctaacttctgtaagccacagtttcacaaaactaatggggacaataaaacacattatgcaatgtatctcttatcatcctatgaaaaaacaggcaaaagttttttatcaatatggagaccagtattaaaatgttattagcattgcaagtggacaaattggtagatgaatatctttaatacaaagtttattttaatattcactactctgaagctgaggcagatgaggaagaatcaaactttaccacaggacagagctgataggactccattcaggtcgtaggtcaatccgttatttatagataacaaaactcaagccctgagaggggaagtgacttcctttaggtcaaataactaaagatgtagagcatccctttgctatagaaataacacgtccttctccgtccctaactcactcccactcactcaaggtttcccaggtattacctaatactctaatttccaggtagttatcctctaagtatcttacttctttctaggaatctgaaggtgaaatatctcattacttttccctctcacataagattgtgaataattaaaatggtggtaattctgattggtagtaatagctattcttattataacagtgaaactataatatttttcaaatcagaaatgattcagatgtacctacagaatcttatgaatgacagctctgagtaaatgatattattcaatttaagttaaggaggcttattgatgttcatcaaaatacaaggagaaaaatatctcataaatcagccttaagttactgcagcctctaacaaatgaaccctctatgttcagttcacatcagccccacttcacatctctttttcttatttcattttaattttacatctcacctcctcattcttgctttagattctgacaatttcagtgtggttaacaactgtgactgataggaatcttttcaatatttttggacagaatctggagatatgttaatgatttattagttgattttccagaatctgtttccaccattcttatcttcatatgctttttattattatgtaaaattttgataatttgtccctggtatattagatggtgatgaacatttgaaagcactgaatcaaatgaaagcttagccttcctgccttgccttaaaatatctctctgtattgtgccttatgcggccctgtgtattagtctgttttcatgctgctgataaagacacacccaagattgggaagaaaaagtggtttaattggacttacagttctgcatggctggggaggcatccaaatcatggtgggaggtgaaaggcacttcttgcatggtggcggcaagagaaaacgaggaagaagcaagagcagaaacctggataaacccatcagctctcatgagacttattcactatcatgagaatagcatgggaaagaccggcccccatgattcaattacctccccctgggtccctcccacaacatatgagaattctgggagatacaattcaagttgatatttgggtggagagacagccaaaccatatcatacggcccctggcccctccaaatctcatgtcctcacattataaaaccaatcatgccttcccaacagtcccgcattaacccaaaagtccgtagtcccgtattaactcaaaagtccacagtccaaaatctcatctgagacaaggcaagtcccttctgcctatgagcctgtaaaatcaaaagcaagttaattactttctagatacaaggagggtaccagaattgttgtaaatacacctgttgcaaatgggagaaattggccaaaacacaggggttacagggcccatgcaagttcaaaatccagcgggccagtcaattttaaagctccaaaatgatctcctttgactacaggtctcacattcaggtcacatgatgcaagacgtgggttcccatggtcttgggcagctccgcccctgtggctttgcagggtacatatttattacctcctgactgctttcacaggctggcattgagtgtctgcaacttttccaggtgcacggttcaagcagtcagtgaatttacaattctggggtctggaggatggtggccctcttctcatagctccactaggtgatgccccagtagggactctgtgtgggggctccaaccccacatttcccttctgcactgccctagcagaggttctccatgagggccccacccctgcggcaaacctttgcctggtgatccaggcatttccatacatcttctgaaatctaggcggaggttcccaaacctcaattcttgacttcagtgcacctgcaggctcaacactatgtggaagatgcaaaggcttggggcttgcaccctctgaagccacagcctgagctctacattggcccctttaagctatagctggagcggctgggacacaggacaccaagtctctaggctgcacacagcacagggaccctgggcccagtccacaaaaccactttttcctcctgggcctccaggcctgtgatgagaggggctgccatgaaggtctctgacatggcctggagacattttccccattgtcttggtgattagcatttggctccttgttacttatgcaaatctgcatctggcttgaatttctcctcaaaaaatgggtttttcttctctgctgcatcatcaggctgcaaattttccaaacttttgtgctctgtttcccttttaaaatggaatgtttttaacagcacccaagtcaccttttgaatgctttgctgcttagaagtttctttggccagataccctaaatcatctctctcaagttgaaagttccacaagtctctagggcaggggcaaaatgccaccagtctctttgctaaaatgtaacaggagtcacctttgctccagttcccaacaagttcctcatctctatctgagaccacctcagcctggacttcattgtccatatcactgtcagcattttgggaaaagccattcagcaagtctgtaagaagttccaaactttcccacattttcctgtctttttctgagccctccaaactgttccaacctctgcctattacccagttccaaagtcactttttgggtatcttttcagcaatgccccactctactggtaccaatttactgcaataatagtctgttttcatgctgctgattaagacatacccaagactgggaagaaaaagaggtttaattggacttggacttacagttccacatgattctggagcaaagtcagcaacattgtgagcagaggtagcagcaggcctggtcttgctgccttctgatggaacaaaacgcccttatttctgtatttctgtggttcttaagtaagggtgcacaccaaaatcttctggaggaatcatttgaaaatgcaaatgctcatgacccaccctaaaagatttggattgggaaccactgcttagttgaatttgagattctatgtgtaaactagaaatgtcagaaagggtttattacttttctcagatggtgaaaaaattacgcatatgtattgggaaggaagagattggacttaatgtggtgtgatttgcaggaaagatatctcagaccaaaaatatgttccacggaccagccttccacatttctcaaaattccaattattagagtcattcttttggacttcttattagaaatcacctgttcaagtctatattataaattaagtaatgcattaaacaactaattaatactttagcacagataagagtgggtctcaccttaatcccaagggaaatgaggcacatggcaggtaaattatttttgatgagtgtgagacagttgagaggagagttttgtaacaagggtagtggttccttaacaaagcaaagcgagatgtagcacctctgtaaaaggagagaaccctaagggcaccatgggaggggagggggttgaaggcaaggtacacttctgccagaggttatccaattgcccttgatgaagggagcctgcttttctctcttacaggatcaagtctctcttggttacaatgaccctccactgaccctggttcatttaaatgcaaagcaacaaaaggggaaaggctggagggatttaatcctaccatttaggctacatagtattaaacagctgattgatttggcccattcagtgaagagaaagcacacactgtatattcaaagcaactgttcgagtttatttgggaaaacagttaaaccatattagataaatggagaaacgactttctcaatcttttttgcaaatgccattttctgtttgctcacctgaaacttagccagagttgtggagccttctaagtcctctggtggataggagaagtgacttcgggtcaaatattatcagaacctttcaatatgttgagaatgttgaagtggtagcaagcacaggatcctagtctgaagggaggattgaggggatagggaaaatagtcatgtagatttggctgttttaagttaactgacaaatagggaaatggtgaaagttctggtcatggctataaaagaagttttggtacttgggacattagcaaccacgaattctactattccttttatctctctagatttcaataaagcccatttgtccacatatccttagagcagcatatagttaagagactgtgttcccttaaaaatgtggttttgattaatctgcctttggattatccagttgctctttggttggataacttgagccttggccttcattttttttcttttttatatttggccatctaatagagggattaaagcacatatcagatctaagcagcaggatttgaacaaagccaaatgcatgaactctctttcttagtcctccccctttaaagttagcatccattccttaaaacagtaccaatgttttcaattaaggaagccagttgaagtggcatgagtgtgcaccactttcttaaaagaagctcagaagccagaacaaaagtcttggcagataatatagtggaattaaaatctagtcactatagatttactggaaatctgctcaaacctccccaagccccctatatcttaacagtcttgatggcaaaggaggatggagtgactttttaaaaatttttgaatttcttattacactctcgtgaacttcaaatctgtcagccaagtcatgaaattagttaggttttttccacctcctctggcttaccagtttcttcctgtaaagttcagtgccatgtccctgtcgtccttggaatgactcattaatctttcttttatgaccttttggtatggttgattcacagattctactttcacatgttaattcccttagcatagtggttctcaaagtttggcctcttgactagcagtgtcagtatcacccagaaacttgttagaaatgcaaattcttgggagccactccagaaatagtaaggcagaaacaaacccaagtaggagtactggttgggggagcaggcaatctgtgttttaacagattaggtatttccgatgcatgcaccagattgaagagtcactgcctcagttatagcccatcctttgaggtgcttctttgttgcttcattgtgcatattatcctcacttagaaccaggcactaacatgagaaaatcacgttttcattggagtttcaaggtggtttggtgacattgattcctgacactgccccaccaaccatgtgtgcacacgcgcaagcacacacagacacacacacacaaatttaggaaataaaaatattaatcattacttgaatattccaggaaggggatagtgagctgcatatctctctcccactgggtgaatcccaggaaagggcaaaatttccccatgtcaggcatataagtttatatagattatccttcagattaagttcttaggatatatagatttgaggaaggtatttaagactttccttcacaatgaaaatatactgtaaactatgaaagcatgtcttcgcaaattaatataagcaaatatcctgagtcttctactcccacaccataaatccctaaaagtttagaaatacatgtagaactggttttgattatagaattaggtacttttccttgttttgcatatgtatcctgttagtgaactggaaacttaagctatttgttccttacatcttaatacacagtagagtagcattttgggggctgccttcacaaagttcctttttggcaagttggtgatggcagcttagtacaatggtttggagtactgtaacagcattctgcagtaaatttcccagtgctgatggcttagaatttgctaaatgtttctgcagaactttcagatctggaaacctgggcaagatttctcagaaagggcagaagttaaggatggtgatgtagaaagttgtaggattccctctcctgatagaatttacgtagtgagatactttgcagatgatttgaggacctttgttagtctgctgccaaacagactaactggtctcttccagccaacttggtcaatttaataataaataaaccttgtcaatccagttgtttgactaggttgtaagttaactcttggttatttaaaacactggctgattatttcactgaagacacatagcctcaagatacagcctaagtttgatatattcctattaagaaagtgaggaaatattaacatctacaagccacttgcatacaattttatatatttggtcaatggacttcagattaaacataattatttgagtcacaggaagcaaacatttataagttagtatatttcacctacatttcttttaatctgagcccaagttgactgaacccaggttcgctgtgttctggtccataatatgtcaagtggatatgtcaggtgataaatgttcttctattctttctgaggctgggtttcagtatttacaagggaatcctcagttgtaattggctccttttattcttatttgaaataaataaaacctagattaccttgggaagctgagtagtgtattaccgtaagcatgagctttggaatcgctgagacctggattttaacttttaactctgccactttgtgtgtgaccttaggcaaattacttaaactctctgagcctcaggttttctcatctattaaattaagcatgataatacttacctcacaggacatagtgcctggtacataagaaatgctcagtaaatgttagctatcctcttgcaggcaaaggacttaagttgcatttgagaatctaatcttaattaagaggcataaacatggagttgcaccagtgacctggaggaagtaccctgcttgcctttaccaggtcaatcatgagctgtgggtatagatatcacataagatgttgaacagaggggaagagagggaaagggccttaggttgcctctctgtgttctgatttaataacaagtccaaaaggattttttattcaatagaggaaacaatactaaatggtaagatggaagtacataattttaatggaagaagtaaaaactagagttaggagaaataggaaaaacttcataattgaactagaagagcataaagaaataattgtaatacaatacatactgtaagaaatcttattaaggagctacaagtgacagtgggaatgtgagagagaaagaaggagagacatattgaaattattctgattgagaagattcggggtgaggcagtttctgaaagctttatccttagggcctctcacctcctctagctgggagacaagtctgcatttgcagcatacataattgattatctcctcaggtgatggtctcataaatgattctctttatctctaatttataaaacaaaagaatgaagtgaaattattggcagtagggacctatagatatttggagacagtaatattttaaattttgctctgacactgacagaaagatgagatccactaaaccactgtagatgccatatattatgtgaaagataaagtatgtaagatatcaactcatgcttcactttttaaaaccactctaaagtaccttacattaagtgtacaacaaattttctaaataaactaaggatcagtaggatagtctctttatagttcttagacaatcaacaatagttatagttttcctgtaaggaaaataatttttaccttaccaatttcttttcaagtttgatgtttatcaaccacactcaaaaggaaaatttgtggttgtaacatttttattgcttctattgatcagtttcctgtaatcgttccttctttgattaaaaaaactcttctgacagttttgctaaatcctttaatttatattttatgaaaatatatctaaatatgttatttagttacattaacagttgcttacaacaaacttgacaaccaagacatttaagagaaagctctgtgaggaagtgcctatgtacctaacaaagaactctcattagaatctttgtccttaaaggaattctaaattttggggctgtgtttgttcttcacttttgccacttgatcttcaatggtatgtaaacagtctgtaataaagtgacactaatgctccttgaatgtcatgaaaaatctcattttagtttattatgtcatagggttagtgctcatgtatgtaagatgctaaacatctgaatatttgataacatttgaatgttatagcatcatattgttattgccaatgtgcatgctattttagaatctttatggatgcaacagcagcagaaagcaatatcaatatttagtatgcttgtaggtcattccaatttcagtaaaggagaagaacataatataccaggctaaggataccactaccacaggaccgctgactgtttagggacagaaatagggacctcaagaccacttaataaagattaaagggcctgattttcttaggtacagcagtatctaaacttctctatacatatatatgagaatgtttcgaatagatgctaatcaaatagatttgatcagtgagtgggtttttgagggtcagttaagaaagttatttgacccaacatgtagtgaaaggaagtattgtataatgttttaaaaacatgggatctggggtcagattttctggatttgtatcctgattgtgccacttaagtatctcaggcatgtgacctctcaattttttcatctgcaatgtgggcacaatgatactctttgacctatgggatagttgtgaaagttaactgagtttgtcaatgtaagaggttcctagaacctgttacataataagtcatccacaattttgcatttatatttatcactgttattagttacttgagtctaatggctctttgtcctggagtaattttgagacaataaccagcatattgaagaaatttcaattgattcattttctttcttaaacaatcattattttttattgctctattctactattaagaaaatagtattgctgtataatctctgattagaatcacactcctcttaaaatatgggctatcagttaagaagcaaaaggttggtacagatccatgttccacattactcttttagccagttacccagcaaccagatgcaaacaatttataaattaaaccccaccttttgtcagaagatttgaggcaatttgtaaagttaatatgcattgctgagatcgaggtgagagatcagaaaccaatcaggagaggaataaagataacgatcccaagaatctaagatgcgaaactgaattcagttgaataataaagatcagattttcctggcatctgaggccaaataaacaaatacccaaaacctatgatagtatttatattaatttgcagagaaccttatttcttaaagaaaaaaatccccccctttttttttgcagtcagatcttgattggttaagccaattcaaagggacccttaatttactgggggctttgttacacacatagctaatagcatgactaagaaaataaccagacaaatttaaaaagctatttccaggcatttgcagacacgtgggcacatattcagcagggtttcacaaatcttctgtgtctataatcaatagttaaaactaactctgcaaaatgtgcgcataaacaagatttccttttcatcttccttcccacttttttccttctctctctctctgtatgtgtcttctttctctctctgctgtttgtttgcttgctagtatccatcccttgcatccctggattgcccaggcctgtcacctgaggaaccctacctgattgaccaagctggctgatgtatcctactgttctcttctctatcttctctataaagcagcaaataactctagcattttagaaaacttttcagcaaaaaatagggcaaaaagtgtgttttagatgcctcttggttaagttaaacctttagtcaaatagaattttccattaactgataagtcctttaccagcacagtcagtataataagaataaagtgccatctgatgggattttctggggtagtgagactattcttcatgttgattgtggtggtgattatgtgactgcatgtgtttgtcaaaactcatagaaatgcacactaaaatgggcaaattttactgatgtaaattgtacctcagtaaacctgaccaaaaaaaatgtgtaccatctccagtttttttttttttttacttttttctattataaagggagagacttgaaagatatgtggatggatgaatggatagataaccaaaatgctatagagatagaattgtgtagttatagaaaagcactgagacttagaccccagaggtataatttcaggctcacttatactgccagctgtactctcttctcaaagtgtcaccagtaaggttactttccctttctggaatttgtttctgcctctataaactgaaagcattgcactagtatctgattaagctcaggcaattcctctggtgaggtggcctgatttgggggaagggtaggagggggaagtaggcagatttgcttgagtgtcagaaaataaatcatctatcacaaaaacaggtggaatggataatgtcatgtgaaatttgagaaacatctgttcgcctatattagtgtctgggtcaagatggagccacctgggttgaagtgatgtatcaggttgccaaaatcagtgtctagttgacccaagatgatttggccagtgtaaaacaagactgttatcagttttacagtttttagggttttttcactttctttaatttctggggaattgttattttttggagctagctggggaagagggaaagttaattaataaagttaatctcagtgtaagagaatatactcaccttaaaagagtaaagattgccttctaagaagagtaggtattattttctaaatattttactgtcttgctttactgtaattgcttgctcaaatagatctctttcagttagataaaagagaaaaaacctggatcattgattgcataaatacagaatggggaagagtaatttgtttagtaatattgatatgtgctttataacataacctgattatgtttgggggagctgaatttccacttccaagcacaaacagacctatatagaatagtaaaattgctaagatgatgattttgaaagagaaataataagagccaaggtaaaccatgttctatgatggaccttggttgttttcatcctgcaaggagcatcaataaatgaaacctgccagataaggttctccagtgataaactagactactcttatgccaatgacttgccaaattattgtatatagccagtatctgcatgattttatgattcataacccaaaaagggtgtgtttaacataatatgctgcttgaacctagaaatcagcagcagctgagaaatctacatttcagaaatacactggaatatgttcctcaacagagtgtgtggaagccaggcttttaatatattaatacaatgcttttggaaaatatatcacagctatccccagtgagagatgactgctttttagtgttcacttaatagccacacataaatagaattctttgcactaccttatgcaatgcctcctcaatcacatgtgtattggggcagggagagaaaggggtgcagaagccttttgaggaggcagatgtgcagttggggtctcttgccatacagaaagcttgaaaagaataataaaaccagtcaatggtaattttgtaatagcttagatgaccctgaaccccttgaaggtgaagtccttgacttaatttgtttttgaagctctcacccagtaccttgccttaaatgaagtatctctgtttggctttgtatttttttattgcttgctatgtgtcgggcactatgctacttctttcttgtaggttatctgttctaatctctaaaacaatcctgtgagggaaggtatcattattccccttttacagttgagaggtcaagtaacttgccttatagtcacagagttagctaatgataaacagctggaattcaaagacaaaaatgcttttttaccataccagagcttgcttcagtgtccagagattgaccatgcattaatttgtacctttaatatatgagtattattattaaaatgtatcttttcaaaaaattttttaagactagaggaaattcatatttaacatctccacagtcattatttaacttattttcatttaaaaataacagctttattaagatatcatttatataaccatcaccttttaaagtatacagctcagtagtttttagtgtatacaaaaacagtgcaaccatgataactatttgattccagaacattttcattacccacaaaggaaaccctctaaccattagcagtcatcccccaggccccctgcccccagccactggcaaccattaatttattctatggcatattctggacatttcacataaatggaatcatacaatgtgtgacattttatgacaaactactttctcttaacatatattaggttggtgcaaaagtaattgccattacttttattggcaaaaactgcaattacttttgcaccaacctaatagttttcagtttattcatgtcgtagtatgaatcaggacattattttttcttatagctaaataatattccattgttattgatataccacattttgcttatccattcattcatcagttttgatggacatttaggttgtttcagcttttgtggctattattaataatgttgacatgaccattcatatacaagtttgtgtggggatggatcttttcaatcctattgggtatatacctccaaacggatttgctgggtcatatggtaactctatgtgtgactttttgaggagctgcaagactgttttccaccattactacagcattttccattcttaccaagggtatatgaagttccaatttctccccacctgcaccaaaacactcttccaattttaaaaattattatagccattttagtggatgtggagtggtatctcactgtggttttgatttacatttccctaacaactaataatgctgaacatctcagttgcttattgggcatttatgtcttccttggataaatccattcagatcatttgtcagtagaaatccctgataagatatatgatttaaaaatattttctcccactctgtgggttgtcttttcactttaattttgatgatgtccagtttatctgttttctttggttatttgggcctttaatatcatatataagaaatcattacctaatccaatgtcacaaagatttactgctatgttttcttttaggagttttatagctttacgtcttacagttaggtagctgatccattttgaggtaatttccgtgtgtggtagaagggaggggcacactttattttgttttgcagtttgccccagctccatttgttaaaagacttaatctttatccattgaattgtcttgacattcttgttaaagattaattgcccataaatataaatgtaagggtttatttaatatattttcatcaaattatgaaaggttaatattgttaattgtgcttaccatgaatttgatttaaatttttgaatttcagctgggcacggtggctcatgcctgtaatcccagcactttgggaggccaaggcgggcagatcatgaggtcaggagtttgagaccagcctgaccaacatgataaaaccccatctctaccaaaaatacaaaaaaaaaaattagccgggcgtggtggcacgcgcctgtaatcccagctaatcaggaggctgagacgggagaatcacttgaacctgggaggcagaggttgcagtgagccgagattgcgccactgcactccagcctgtgcggcacagcaagactcttatctatctatctattgatctatctatctatctatctatctatctatttatctatatctgagtttcacataaaacaagatggtgataagatacaaattgtgcttagttgctgtaaaacagttattgaaataattttgtcatcaaggaagcaacagtgaatggtttattactttgaaaataaatataattgagtctttatcataataaattagtattctctactacagcctaactttaactgtgaactagattactcaagagctagttttgaataaggtaatatataaatgtcatcattcattggctgccttagatgaaatctaagaatttttttacttgttagccactaaaatttccaatgagaaaaaaaaaagccagccaggaagttatcctacacaaattaaagctaatcataagacattttgaaaaataaaaataataggaaagtcatcatccatttccaaaatgaagaaatacattttcaggtctctgaagttctttcttcctcatgattttattttggttgagattatccagagatttccttcaaataatagcaatggacaacaaaatattttggtactatgatatggaccatttgatgtacaaactatatagagaatatattggttttgaaatgggtgtgtttgtgactttaactttccaaagtcaatatttaccatggatgcaattagtggctgatgttaaaactaaggtgacggggcttgtgcttattgtgctcttaatggtctcagcaagttgattaaatttgtttccagtgggcaatacacttgaggcaaagaggccctgcatagagtttagcaaatttatactttaacaattcttaaatattccatatcatgagtggctggtttgagaattaagattttagtcactaaaaagttagaaagtagcaagagaagttatgtactatttatcttctagacaggcctgagagaaacaaaaaacaatattgtataaatggtggacaaggaataatacttaagctgtgggatggtatggtatatgatttttatgaaacctcagcccaggcttttgcaccaaattgattgcattttctgaaacgcaagaagtaaagccactgtgaagacactagggatggttttaaggatgctgaagttgcagaaggtacgaaggcagttgtgttattgaatactattactactggagaataaagagttttgttttaacaccctttatttagactggccaaacttcagacttttaggttaaatagtaacagacacacacacacacacacacacacacacacacacacatactattttaaagtctctgtgaaaaggaagttacccattcccatgtgttattttaattgtcaaggaatccttgccgatgtttagttaataatcttttccactttcattaaagcccatttcctttttatcagttttctgtagtcacagcagcagccataaatttctgaatattcaaagataatattccaagttaccattgagccttctcttctctcagcttaacaacactaatgcctgcaaactttcctagaaagattcattttccattactttaatcatttctgttattctctgtagaagagtattcttctcttttaaaggtaataatgctcagattgacttaagtggagtttcttcaggagattttgcactttttatacattttgtataagagaaggagcctgacaatctcagaattctatctaagagacttccatttcttacactgacatttctcagactgtcatttcccatcatcttatgtggtaatttatgaaaattctataagcaaggcttatgccaaagcagttcccaaaggcttttgctgttggagtcagtttggccatcaactcatgggaatgacttgtttaagtcactttttgtaagaggataatcttccaagctttatcttatccaaagcaattcagttgcatgaaaataataaaaagttgtaattcagatggagacataaaaatttgatttaaaagacctttttctattgctatgactttatttggaatgtataatgcagagatatgctgagtttaactcatataatgagaggcagagtgtacacttgtaaatcttcatagaaaggatttcacagctctcagtgctgcttagtatcaaaaatctaaatgagataccaactaaacacagatatttggcctgcaatattgtatagtacatctagttaccctgaaaacatagggagaggtcttgagatatctgtgggctacttcactattacaacttgccaattctgtaaatggactcactctatttattaggaaaatctctccctcttgtttgagctggaaatttctaaatcttttaaaataaaaaaaattaatgaacaaactctgaaataatcaaatgcaccaagtagaggaagaaatcagatctttccagaaaatcactgtttgttttaactggtagcaaagatggatcaaattgtaaagttaaattaatatatacatcttaagtaaaacacatacacatacacacacacacacagacacgcacacatatgtatggttctcaatacttgaataattttatgatttaatttggtgattaaacttgtcaggagagaaaaactagtttccctttggctttctgtaaggcaagacttggtcatgtcccagttaatttgggagaatataactaggtaatttagggtgtctgaattttgcagagacaataggtaaacttcacagagtttaggcaaaaaggattaatcagatgaattttcaggggaataaacttttctcttctctctcctctcccttctctccccttttctctttttatcccaccccaacagtttgggctggaagcagcttacagcaaatcagcaccttagcactcttaatatcacccagtgaaaagcagggttctattcttctagccatatacacaactctttatgccccccttcaggctcctgttggggattgtattttcccttcactattgcctttgatgtttattttaaactgtgaatctctcctgcatttaaatacttgttgcaccccttagcagctgctgaaacgtattgcaggggttccactctgatgagacaattataaaacaatctcactatctcctaagcccgcacctggggtggtgggttggggatagtgggggagtaagtagtggagagtagcagtgtattccttagaggaaagccttaattttggcaggaacagaatcctccttaaggaggcccctgagttcacactcttttgggtacttccccatgaagagtataggcattttctgacttctcatagttcgcaaaggaataaataagaacaaactctaaattaccacagtgacagtgactcatgaccatagcaccagaaaagacccttggagccagagtactttggttgtgtgaattcccaggtgtgggcttagagagatagtgggatctttttttgtagtggtcttgctcaagtggaaaccctgcaatgtttcagcagctgttaaggggtgcaacaaatatttaaacccacacaagtggcaaaggctgctgagctgctatttatgtaaatattgtaatttgggcctgaaaggaattagattttgtatattaataaataaaattggagtaaagaaataaatcatctatctttaccacctttctttgcaggcctctagcttgatttctgtatctcttaaagacttatttaggatgaagatattggtcatacagccttgtaggcattgctatatcaagataattttttcctcatttagattctgccaagacagccatttgtcggtcagctcaggggaaaaccagttcagtcagttactttgtgttcaaagtttagcccaaggaacactgcttagcctcaggagcactcgaggtggcatagctctcaaaaaatgtaagaatgtaagtcaggtgcataaaacaaaacaaagcaaaaaaaaaaaaaacataaaagtcagtacacttttttcatggatcggttttaatctctgttatgaattctcaaataagtgttttttcttaccttaaatttatttttattagtgatagaggaggtttatttcataaatgaaattaaaaatctattagaatatcagaacttctgtgcatatatgcctaaaatataccctaaaactaagtgaagctaaattgatagaattacaaaagacattgatacttccataatcacagactggaggactttaacatctgcctcggaatgttatagatcaagttggcaaaaacctccataagaatgcaattagcaagcttggacccatggaaatatattgaattctgaatcaagagttagagaataaactaaaaaataatcaaggttagaaaataaaatgtttcttatgtgctgtattcttttccagcacgtaagggacattttgaaaaattgattataatcttggctgtagagaaaatcttaaataccaaagaatccgtatcctatagaacatattctctgaccaaaattcaatacaatttagaaaggaacaacaaaatgataaccaaaaatccttaagtgtttagaagttgaacacatacatgtctgagtgatttataggaaaaggaaaatgttaatgtgaactcaaaaaatgtatttactttattggatatttatctaatgcattaatacttttgattaaagaggaaaatagtttttggggcctctcacacatatcaaatgataagattaaacaaatagcataataattcataaatatttgtgggggctttttaaaaagtgttgttgagcaaattaatataatagacaaaattgtaaaaagattatttaatctatttaggacaacatttttttttcaagttctttggtagccctagattttctatcacacacttcctaacacagtgtgttgcagacaggcattcagtgaatttttgttgaattggttgcagtagaggatagtgaaaacatataccttggtatagtcttgatgagttaattaaaaattattcttgctcaatcaatatactaggttctctaaggttctctgttaggcagcctggatgaatatattgaagttgcttcaatttagattttaaattaattcagattgaccttcctgataatactgctaaataaacgaagcataacgtaattggttaatcttttcaaaaagacaaagtaaatctcaaagccacatcccacagatactctcttgcctcggtcagatgtgggtgaagtatcttctctggactctataatctgtcatctaagccagatggggatacatggtttttgaaactgattagccagggtgaacttgctaaggttatagatagaccatctaaatttacttctaattccagactaagaattaggtcccagttcctgacttatacaagcccaaagtgaaaataaatttcatcaaacatatttttatcttttaataagtttgagcattgtccgagtaacacataaatggttaaaataatatttagactgcatttgtgcctgcatttgaattcacagagatatttataggtgaagctctctcttcccttttgcataaacattaaaataattcaatcagcttgttataccagatattttcgttatatctcccaaatattagcagtttgttccataggatttaatcatggttccatccagaggcttattattatagcagtaatttatggcaatgaaatcaatttgaaaacatacagaacctaagaactaacaaaatgtagttgttatgtgtgaattaaaatataaactgagaatttgaaaatattcaaataactagaatctctctaatttggtagactgctgacctggatttgtgaaacattttcaataggaaaatcttaaatatcattctaatactttcaaagaccttgtaattttcacttgtactcttactgtgaaaattgccacattgtctcttgcattgtggaggtttgtgtaactttattatctatattaaaaattccttaaaaataaaaactataactaatttttatatttccttgctttctacatatcatataggtagtatttaataaatacttacatatgcaggtagtgtgaaagggttaaagagcaccagggtcttgggcttagtcttgcctctgctactacctctatgcctttggacagtgggaatcaatgaatttggaaaattagtggtggagaattcagcagaaaaaaatggtgaaactatttgaaggaggaaagaaaaaagtcaaagttgtgagcaaggtaaagttggtttctacgtgcttccatgatcctttagatcgctttccttcctttcctccaaatctgggaattgtcattgctacacatacacactgctccctccacgtactcctcctacatgcatgcatacacatatacacacatttattgaaacaaccagataattgttataaatatgtagttttatctagacgattgccttagtcttccatattgcctcgctagatttcacttgcctacctcagtgacttttatgtttgggtagccttaactcaaatcttcctgtagttggattctattattctgtgcaatagtaccattctacttttatcatgttgcatttttcagcttggcattctttgagtggctatatccaccatactttccccccatccacttcccccgccccccaccactctgttcgccacacaactgtaagggatatattgaggggtttaactctgagactttcagttgatttcacactcttcatatttcatttctgcaggctttaggtaaacagcatgtcataggcaaatccagcattatagtagccaaaatgttctgaaattccgactgccttggtaattccttagagttaaaaaacactctcaaaaaagcattaaatttaaaaactcaagttcgtaattaaaaaaaacacacacacacacagccccagttaaaatgcacatgttgtaccatgatgagaaaagaggtcactggataagatctttgcaatacattagtatgggaagattagctagtgctttggctttgcaaaggccaaagccagatgctgaaggaatgggacagcagggtggaatgttgaggaagggaatgtgtgaggcatggagtttacccataaaggtcaattcaaggcaacagtctacatgtaaaagtagttttcagtcaacttaggggctacaatgaggactcataccttttgagggtggcagggcctggaagttagaggtaaattgatattgatagaagatgtccttttgttctctcatgtctatgtttaaaagcattgactagaccctaagggccttgtactatcttaaatgtaaactatgcttttttcctcatcatcatctttctccagtctttttctactccctgctgcttctctcattttctcttctattctttccttttctattttccctcctccttggcatttcccttattcttagtagccatcccagtcaacttcagtgcttctaaagtgcctttgagtactactagttactgctatggtttgcagagacaattcagtttataaagactttttaaaaaatgcatcaacatcctcttcacctcatctttatattaagggctgttgtgtttgtacctctgtggacacacctggaaaagttgagaattccattttgactgtgtagattttaagacaaagttgcttcttttggttgaacccctcttctcagtcatcacccatctgtctcagtgcttttctttcaactagttgtgctgtttgatagaattggaaacactgcagcttacatctgtctgagcagatggaatgcattttgcatgagtgttaactgattcatgcattacataaagaaagcaatctgtgttaaaacattgtgacattgcaataaagcactatctgctgtatgctgaaacctgtttgcttacggagggttttgttgctcttgccataccctcacccactgccccatggttaagcccagacaaaccttaaaaggaaaaggtatacaatctaccatagtgggagaaaatagtaactgaaagaaaaaaaatcctgaatatgtaagtcattccaatagatgagttcttttttatttttgtagtgtattgtcattcggagggaaaaaaagagaatgtcattgtggggaagcttcttacatggagaactaaatagtcatcaatcacttgatcatgctttccatatactttggtaaacaatgctgcttggaagtgttatcagagggtttgaaatagtgtgggccctagtctcatggagttcctatgtagtttcctcagcatgtgcagttatagcctgtgactttaaatttgaattagtgaccagcattgaaggttttatggtgtcacccatttgtaacagcaagcttcaatggctttgtacttttgtcccctgtagatctggcttgccacatagcagtatgttgcagtctttccttagttgcctactagtagctattcatttatttcctgcaaatgttgtatgtatcccacagccaagaacacagaactttattgtccattttgtacaattcgtcatttgagtgctatagcgtaatagagagcagctctatgtgcaaatgatgttactatgtattttgacctattgtttccctgcaggagtaataacaagggcaataaaactcagtcaaagctgctgtataagcacacataactgcctcaaattacagggcactttcaaagctacaaagccactgaaactacgaaggctgtcttctgactcctttcacagttctaataagcatgaccatgactgtcccagatttctggaaggggaaaaacattattctgttggattattctggtgattctgtagctttttagctacaaaaatctgtttccatacaaatcctttgactacatgtagcaaaggtttgggtaatttaggggtatgttaagaaaaaaaaatgtagaagtaaagaacttagagctagctctcactatcacatgtccccatagttgatataactacagagggtatcaactgcaagtatttagtgaagatttcagagtagtagccacaggttaggggaagcatggatgaacattaagtaatgttacctgacaaacttttgtcaatttggcaagagccttggcacttcgattattttgtgagctcatgccctctgaccgtgactagcttcttcattgaggccctctgactgaatagagttgtgaaaaattttgggtggcatcacagtgcaacctagggtcaatgaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatcttaaagtgtcaaggttaaaatagtatttattcaactccaggatccatctgctgaaagtcagaaatatcgactcctgccagttctgagttttctccaaaaggaaaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaatttaagtctcaggtgaccaagacactgacaattcataactcttctttacaattattgggtaacctgtatttgattctgggtccccagtgtaaaaattgaccttgcttcattacttttgagatacaactaaatttggggaatttggtgtcgcatgaatgcaagtccttttgtaaagtagaaatgttttatgactgttcctttatttgctttgttatgtttaacaagattttcctgcattggtttttgttaaaagcaggcacatatacctcttaacaatgccctgtatgtgagcagtatcttaaattcagggacatgcaacatattcttttcgtaggacagatttgaaatgctaatattaattttagagtcatgaagaacaacagcaccgtaataaactaggtttttcccaggggaagtggactaaatgatgctgcttatttgattatctaagttaattaattaagaacacaaatccttgccaaactgaaatcaacacattaagggatatgtattctccctggatagtttgaaatgatactgcaaaaagaatatacgttcatcttaattactatattttggaatgcaaccccagaaaacagatttagttgtgtcagcataaattaatcagggaagttttttaggactttatttaagtccttcacatggtagcatatattttttctctagaactgtttaaacatactgtatttgagatccaataatttatgttaataactagcctttgcatttggttctattctctaattgtttctggtgtatacatcttacaaactataaatttctccaataaactgtgaatagaacagtttatctttccaactctccatcctcttcccctttttaaaacttcattcactttttgaaattccctgctcactcatggtctcatggtttccctgctctccattccagaaacctgcttctttcaatatggctgaagaacaaccccttctggaactcctcaggctccagccttttctttactccaccttctcattccatcagtacttaactgttcattgccactgttttagttacctcatctgatagtctaactcatgcttaaatgttagtgacaaattaatgtgtccttctcttagctaatattgagtttcattatcttaataacatggaggacaggacttaataaataatttttataccttgttgtaggttgtggagtacccggaagtattttgaatagttgacctattgccccccaaatcaataactgaattattatttattattattattattattaactaaacttgaatgcgtggaatgagtttgacaacaagacaaagagttttcttaagtgaagatgatagacttcttgattctaaatgccaatagacttgaatctagagtcaagaatgactacaaagcattgttactacctattgtcttctgttcctcaaatacgaaagagcctatgaacttatacaaagtatttaagcagcagttgcttttacgataagaatgagagctaagagaatttttttctcctagctctgtgatgcttgaaaattatttaaaaagaaagaaatgctgtcatttgtgacaacatggaagaacctggaagacattatgttaagtaagataagacagacatagaaagacaaataatggatgatctcacatatctggattctaaaaagttgaactcatagaagcagagagtataatagtggttaccagaggttggtggcagtgggggacaggggattggggagatattggtcaaaagacacaaaatttcagttagacagaagaataagttcaagagatctgttgcacatcatggtgattatagttaataacaatatattgttataaatatatttactaaaagagtaaattttaagtgttttcaccacagaaaaataataagcatgcagtgtaatgcatatgttaattagctcaatttagccattccacaatgtattcatatatcaaaccaccttgttataaaccataaatatatacaatttttatttatcaattaaaaatgtaaaggtcattctttgtactcaaactctagttaatgaagcattattaatcttgtggagctagtggctcctgtatgatactccagatattactgataggaaaaacagcccaaaaaatccacatttataatttactactgttcttgtgattttcctgaataatattcactgaggttaaaggcaattgtgagattatttaacactcaatgtagaatctaaaactaaatttctttcttaacgttctaaaactaaattcctttcttagtgttcttttgtgtgtttaacacaaatgttgttaacgtaatttgccataaaactcacattctaactgaaaaagggcacatcctaaaaactggattcataggttctagttcagcatctcatttatgacaagtccttcagctaagatcgcaaaacagcttctgtataatcaatgaaccacaagatggcaccactgaacaattagcttatctcaaggtggcttctaggttctctagataggtgcccaagaatagtgttatacttcttcaaaacgaacatcagtcacttaatcagtcacttctggtgaatagagtatgaaagggaaaaataacaactttatagtggagaaacctggcaggttgttaccttaaccaagtgctcaaggttaatatcaccattgatcaacatggagatatcatgtacccctgatatgatgtgatgaaaagggcatttcacttctgtgatatccttcccaaaaattcacataacctcaatctaatcataagaaaacatcagccaaacccaagttgagggatattctacaaaatacttgaccagtactctttaaaagtgtcacagttatgaaaaacaggaaagactgaggacttgtcacacactggagaagtttaagaagacatgatagctaaatagaatgtaggatccaggtttggttctagaaaaaggacattagtgagaaaactgggaagtcagaataagttttaaaatttagttaagagtattataccaatattaatttcttcattttgacaattgtagcatggccatctaagatgttaacattggaagaaactggggaaaggatatacaggaaccccctgtgctatctttgaaactgctctataagtctaaaattatttcaaaataaaatttttgaggagtcaaggtacagggggaactcttctgaaatgctctcttaacagtagcacatttctatgatctattgtctgtatatgccagacttctatggagtcttgtagaatgatttggcatattaactcagtacatggttccgagacctggagttttattcctctgtaggttcagtgagcatatttttcaaacccaatattaggacacattttctgacgaaataacttcattcaattttcaagtgtgaataaatcacagataatgagggtagaaccaagctgattttttttctgttttatggccatggttggaatcttttaatgacattcagttgtctcactaatatgtcataatctattgattttagacttcaaaaattttgtattttacttatcatcagttaaataatgtatggctaatatttttgataacctgataaatattttgtattgcccaaaataatagtggctcataaataatctcttagaatcaaggaaggaagcattgtaactttttaaagggatgcatgcaaatcagtttccaacatgttgtatttgtgcatacagatgtggaaaaaattttactagcaagtgttcgtgtgaataattatgaaaacaatgcttcctaagttataaggactgaataaataaaaatattaatatataattcctcccagagatgtaaataaatttgaagggtatccaacatactcaataatttttataaactcggttaagttcaggtgtcattacaatcctacgaaaaagaacagtttaaaactgttttattataactgtccagcaaaagtaatctgactccatccaaacaggctgccccaattaagacaagtgacagaagataacacaagctcatgttcttttgaaaaatttaaaagaagctaaggaggttgcaaaaatagtgctttttgtctgataaaagagaaaattgtttctagaacttgatagtattacttcatggattgatccttacaaactctgcctcatttccacttctcatgtaaatctgattttgcctttgcatttgtttcccaagactttaggttaaacagacaggtcttgatcttgggttcctacttttctctggatcaatcaataacctgtaactttttcctttcctttaaaaattctagtcttctgtggctggcatgctccgccctaaactgctcacccaattctggacatttccttgtgccttgattactagtctctgaaccctatcccaagtcaagcacattaccttgctcagtttccgtctttcctgccttgtgtactagtttcttaggtcagctgtaaaaaattgctacaaactggatggcttaaaacaaacaaaatgtattccctcacaattttggacataagaattctgagttgaggtgtctgttgggccattctctctctgaagtctctagggaggaaactgttccttgtctcttcctggcttctggtgttatcaacaatccttgacatttcttggcttgtagttgtatcactgcaatttcttcttgtcttttacatgactgtcacccctttctgtatccctgtgtctctgcgttcaaatctcccttcctttcgtcttataaagaaaccggacattgaccaaacaaatccatatgacctcatcatagtttgattacatctgcaaagaccctgtttccaaataaggtcacattttgaggttccaggtgaacctcaattttcgaggggacactgttcaaccaagtacagcccccagatcaaaccttctgctgagaaatatcagataaggcattctatttattactcatagtaatgttatactgattttttctatgactacagtttggaatatgtctagaaggtaccagccacaaaataggagatctgattccaaacctatgtgttcacctttaaaaattacaaatctgtagcttatacttgcatttagggtaagatctaagctcttataactcatcatattttcaataagagagaattttctagaacttattccttttataaatatttttggttcatatgattcaggacatattaaacagtttagaggctgttgaattaattatgaatcactcacactaagtgatcattatggagataatgcatggctaatatttttgctaacatgataaatattttgtgtttgaagaagagtccagtggaaagatgtctgcatagtatcacataatcaattgaaaaaatgtttagtacaacaactcgttttctgccatcttcaatagaaaattttcacttagattaaatgaaaattttcatttagattaaatgctttggtgccatgcaaacctagattaaagacactaagtaagcaataactttaaataggcaattatgtccactagttactacagatgtaaacagccaaactgttccataaccttcgtcgagtgttttgagtgggatggtgatttctttaaaatgttgataatttaatatttctgttttctatataatactatatatttcatttgtatatattttatattttataacatacaatgtattcgacactaattttaatattttctactttaattgcttcttgatagctggattacctagccagcatttgatatttatcactatcctgtatttcagggacttcatgagaagactggtgcatttacagctgttaaagtgatgaacgctcgtaaggtaatattataaattgcctgtattctcttcccttagtggactgtgttcctgggatacacaactcagaaaatattgtatttgtttttaaatcattattttatataataattattacatcaatctggatttattatagttatcatttaatattacttttattcattagtgtattatatctattactttattatatatccacataaaacaatgcttctttcacagcagaagttccacatattttggtattctataacactgaggaatatatctgtactcctctctgtttctagttgactatttgtttccagggatagcaaagaagagattgcttctaatattgggttaatcctgctgtgttccatcatattattttccctctccaatgatttcctctgataattgaggccattagattctcaatgacaggtagaaggaagagacttatcagaaatgcacatttttcatgtattttctgacagatgagcaaaagagacagtttaattggcaccgttcctggtaacattcataaagttgtgtcacggttcataacatattggcatagaatttgctagcactgatttctgttctttttctttaacgtgagtgccacactttctcaagataatattatcataaacatagaaaaggtcaaaaaaattttacttcactataccctaaagggaaatttgtgtttgaaaagctatacacattgactgaactgttgtcaaggccataaactgtgctttttccaatttgtgcaggaagtgaattgctgaaactgtttaaagagttgtgtgcttccatagcacatgtgtacctatgtaacaaatctgcacattctgcacatgtatcccagaacttaaagtataataataaaaaaagaaatgatagctgaattaaaaaaaaaagttgtgtgcttttagttttgccagtaaatgtcaaaagttgcaaaccaatgtgagtttcgagggattttgatgttttgtagatttattttgccctacaatccatggcttccaaataatcaaacttctactttttgagtgatactctctaaaatacttattttcttgttttaacttaagagaccttgacatacttttaacctacatttcagatactctgacttttaaaatatttaaaaatcatgttcaacccatggaagtttagtgtcaattaactggttttgtaaggaggataaagcactttactaataacaaattgtaattttcccattattacagcagttaaatctactaccatgaatttgttgccaaatttctgtatgtcataagaatttggttttttaaattaaaactattggagaaaattgagagaggaataatgttatcttacttttccattgagtgctaacgtagcttaaagtacttaagcataaatcatttttagagtgtaccagtacatctaataacattttattcttggttacagacccctttacctgaaataggaaggcgagtgagagtgaataaatatcaaaaatctgttgggtggagatacagtgtgagtactaaaagttctcattaatacccaagtagtctttcctttcattttcagcttttaacttatccctttgcattgtgtcattatctctagaagactgctactaaaagtgttcttgcctgaaagtgataacatatttatatcttttaatatattcacttagattcaatcatcatatatgagcactagcatatatcagagagtaggagataggagaaaagggcccttgaataggaatgcattgactgtcagtgaggaattgcgtaaatttacagagcatagaaccctctggctgaatagcaacaaaaaaggaggtgatgcgatctacagcaaattttgcctaaaattggccttggaaaggtccttttcacacgtttatcatgacattctggactaattgcttttcctccattgtgattctaacaaacattaccatcgtgtttgaaccaaatgaggaatgccccacgtgcccacccccccgctttttgtaagagcaatagcaggcagaaaacaaaccaaccacttagcctcaaggtcttcagacatctggtaccatacttgaacacatgaaaggatatgaacatgttttctatgtgcagctttttggcttaccttcagagcagtttttctgataccaacaattctctggctccagaataaaaccaaccaaagataatctctctttttcagtagatattggtgatctataaaatattgtatgggcccaaaagttgaatttttgctcttatcaatataatgaattgatatattttttcctacttttctctcctgcagtcagctatacatgagactcaaatatttctagcattttgtgacttagtaaatatgtctcaggcacattaaaaataacccttttactaacacaatcacattcagaaactttctagttatattagaaagatattactaaacaacctcatgactcatctattaagtactaggctcctgttatgtctataattcatgttaggagactaagcatatccagaggaccagctaaaacagatagtatcatgcttttgtagcttaggaaaccgcaaaagataaggtatggaaaatatgattattttattaattttggtttcatcaaacatttgtgctaataaaacttttttaaagacctgtcccaaaccctctctggcacactttccttagagaaaaggattttgattctagaattggatgaaattacaaaggaagttctggcatccttgagctgcctcctcttgacaaaacgcagggtattcaggccagtctgtgatcaactggccctaagccaggaaatgctgtagcatcatattactggaagatgtgtgagagttttaaattacccacttggtctgatggatataatgtacttatgtgtttctcacaagctcagcttcctgttaattcagagtggcaaacacactaacgcttcccaaacatatctgatcttcatttatttgttttgggggagtttacatttatgtgggcaacccactcttaaaaggtttttctagttggggactttgaattatctgattatgtattttagtaagaaaaaataactgctagctaatcatccagttagtatctctaaattatcttgaatcctttaggataaaaagtatgtgacttgcacacacatctcttagatgccaggggtttatggaaatagcaataatatgtaagtccagaaacatgagttcaaatcccaagtctaccactaaatagccaaaaagtgcttgggaaagtggtttacctttctatgtctcaggttcctcatagaaaaagagacatcacaaatgcaactacatagctgcccagagcccagcgcatctcttgttctttccaggacacataagctttctaactcaaaaagaaaaggaatcaccttaacatcaagctaccaaactagtgaaataattcagtcttgcccctgcttctctttcacttgttctttgtattcttaacctcctaccatcctctcattcctatttattgcactacttatgagttcatattcctctcagcagaaccttggcaacttaattgaaactgagagtgcgtacgcacaaatattctataatagctagtccctgtggtttgctagtcttatgcggtgccaggtattgttactatttcaaaggagggccacatcacaggggaagcagaaagtttaaggatcttacatgacaagaattaaagccacaggatttttacctttctagaaaacagattaagataatttgaagggaacttattaactgaactttgctgggaggttgggatgagactctagcctgagctttcatgcaattctcataccacaagttgtcatgactttattacacaaataaatagaaagagggaacctatcactgagattttcaactgcacatatcaggacctatccttttcccccataagacaaataggtgtctagagatttattttccagtagttgaatgtttataggtaaatccagtggaaaatccttgggaaatactaaagaatgttctgcaactgccagccattttctctgacattgcaaactttttttttttttacgagatataaataccgggcattttaggggaggaaagataatttataactaaaagttaagtcaacttagagacactacagagcctagtgcactgctttatatttatgtcataagtatttttaaagcctagccacattatacctaaatatagaaagtagttgcctatttttcctgctggttcttagagaattagctaagagagaaggtaataactgagttatgtttagttaccaattcatttcagctaagagacttatttccctatatttcagtcattaagtcaggatagtttgaggaaaatgctggggagaactaaagaaaattggtggttaatcccttaattattttccatgtcaattgtccctttcctaggtcattgctcaaaagagttaaggaaatcttttttttcactggatttcagaaccggaagtctttaattcaaaagttttttgtttgtttgtttgtttgtttttgagacaaggtctcactctgttgcccaggctagtgtgcagtggcacaatcttggcctcctgggttcaagtggttctcctgcctcagcctccccagtagttgggattataggcatctaccatcatgcttggctaatttttgtacttttagtagagatggggttccaccattttggccaggctggtctcaaactcctgacctcaagtgatccacctgccttagcctcccagagtgctggaattacaggtgtgagccaccacgccaggccaaaagtcttcttttctttacactctacaaatatatttcactttcaacaataagaatatttcttaataatttttataaattgaactattatagatgaaataggagagctttttaatttacaatcaaataaaatttagagctactatgaattcaaaggaggtcagtgaggaatccatttttcaagtacagaatcacttcctgagtcatctcacatcaccttcaactttattatgtattcaactattttgtattcaccgttggttgtgtcattcacatatgtgaatcttatttcctgatgtgtaatttcctttaagttaggatcataatacctaaatgcacaaaccaattatattttcattgaaaattttaacaatttaagttgtctttttgtaagttaacattttaagatatttttctcaagtgtattgcatctgtatacacaaaagtgtaattgttttcaaattattaagaagcaaagagttttttctagattggctgagaaataagagttacagaaggaatatcaaaaccacttggctatcatggtacaagcagacatcactgaaactttgagagaattgctttccatgtcactccactataattaatatgctgggaatgaaggaggctgatgtttgtagattacggtaaacagtggagggaagtgtatagttctgatagcgctcggagtaattcaaagaagtcaaataacaatgatattttgtgataatacattgcatttatagaatttttttcaaagatttcaaagaactttatatatgttatcccatttggtcccactaacattccatgaagataggtaatggctgctatcttccatcattcttttaaaataaattgaactttaggaagattaagtgaatttcctactctgggctatcagtgctaaacctcggtgtcctaatgcctatggtaggtgtttttttctgactgacatcacactgtcttctgctagagctgtcttgaagctatatattgtacctcggtgatctcatctaaccagatggctccaattatcactatatagataattctcagaaacaatacttctagacctgacttgtcccctgagtgccagacccatatatcctttctgtgcaatcttgtgcagccataagaaggaagtgcatttgtttattgatatggaaagatgtgctttatatactgattaaaacatgaaaattgcagaatattaaaaataataagagcttatttggattttttaaatgacacacacacacatatataaatgcataatgatatgatcaacacacacacatacacatacagacacacatgtatatatacataattatatattatatatacagataattatatatataattatattatatataatatattgataattatattatatatattacatattgataattatatatatatacgtgtgtgtgtatgtgtgtgtgtgtgttgatcatatcattatgcatttatctctgtcatagctctagctactgcattatcatatacaaatgtctgaaagaatatacactaaacagttaatattgcttggggaaaatgttcagtgagagtagaccccttacatattttattagtatatttctctatatttggtatgcatgtgccattgttgtgattaataaaaataaattatcgaaaaaaataaaaataaataaataaaatgtgaaaaaataataaaaatttttaaaagatcagcacagaacaaaccaatacctttaaaatgtaaaggattaccaaataatcaagatagtatggtactgtccatccacatgcaaaataatgaggttggacttttactttatataaaagttaactcaaaatggatcagacacctaagtataagagctaaaactataaaatgcttagaagaaaacaaggataaagctttgtgacctatgatttgacagtggatgcttatatatggcaccaaaagtacaagcaacaaaacaacaaatttataaattgtgcttcattaaaataaaaacttttgtgcttcaaaggtcactatcaagacagtgagaaaacaatccacagtatgagagaaattatttgcaagttgtctatctgataaggcacttgtatctagaatatatgaagagctcttacaattcagtaataaaatgacaacccagtttttaaaaggacaaagaattttgtattagacatttcttgaagaacatatcggcaataggcacaggaaaagatgctcaacatcattagtcatcagggaattgcaaattaaaaccacaatgagacaccacttcacacccactagaatggttataataataaaacagaaaatagcaagtgttggtgatagtgtagagaaagtggaacccctgcatacattgctcttggtaatgcaaaatggtaaagccaatgtgggagacagtctgtcatttcatcaaaacattaaacatagagttacttgacatgactgttcatagaagcattattcataatagctaaatggtagaaatagcccaaacatccctcaattgatgaatggtaaaccaaaagcaatgaaacattgttacatgctacatatggatgaactttgaaaagaactagtcacaaaagaccatgttatatgatttcatttatataaaatgtccagaactgataaatctactgagacataaagtggattagtgattgcttagagttggggtgtgtgtgtggcagaattgggggatgataactaaaggatatggggtttccttttggagtgataaaaatgttctaaaattgattgtggtgatgattgcacaactgtataaatatactaaaaaccattgcattttgcactttaaatgggtgaattttatagtatgtgaattatatctcaataaaactgttacaaaagaaacaacaatataatgactccactcagtgaaaattttatacagtggccagtgccgctggtccagggaccataccttaagaaccactgaactaaacgatcttcagtttaccctttttattcccccagactccaggttaaccagaggtcttcattcactgaccattttagttgagattttattataaattgctgttggatataattagttgccataggattctccttcattgatatactgtactttagggacttatagtcattgattgcacagtttaggagctttgctgtctattcttattccataggatgaggaagaggatctcaggactgaactcaaccttctgaggaagtactctttccacaaaaacattgtgtccttctatggagcatttttcaagctgagtccccctggtcagcggcaccaactttgggtatgtttttaattacactgttcttattctataagaataagttttacccaaggatgtatgttttcatgagttatcacttttgtgcatctacaggaaaacttagcacacaactgttaaggtagtatggtgtattaatctggtctcacaatgctattaggttggcgcaaaataatcgtggtttttgccattagacatacccgagactaggtaatttataaaggaaagagttttcattgactcacagttccacatggctgaggagacctcacaatcacggcagaaggcaaaggaggagcaaagtcacgtcttgcatggcggcaggcaagagagcatgttcagggaaattccccattataaaaccatcagatctcgtgaacttattcactgccatgagaacagcgtgggaaagaccggcccccatgattcagttacctcccacgacatgtgggaattatgggagctacaattcaagatatttgggtgtggacacagagccaaaccatatcatttcatcactggcccctcccaaatctcatctcctcaggtttcagaaccaatcatgccttcccagcagttccccaaagtcttaactcatttcagcattaactcaaaagtctgccgtacaaattctcatctgagacaaggcaagtcccttccatctatgaacctgtaaaatcaaaagcaagttagttaccgtagatacaatgtgggtataggcattgggtaaatatgcctgctccaaatgggagaaattggcccaaacgcaggggctacaagccccatgcaagtccaaaatccagcagagcagtcaaatcttaaagttccaaaatgatctcctttgactccatatctcacatccaggtcatgcagatgcaagaggtgggttcccatggtcttggccaactctgcctctgtggctttgcagcgtacagctccctcctggctgctttcacgggttgacattgagtgtctgtggcttttccaggcacatggtgcaggctgttggtggacctgccattcagggttctggaggacagtggccctcttctcacagctgcaccaggcagtgccccagtggtgactctgtgtgggagcttcaaccccgcatttcccttctacactgccctaacagaggttctccacgaggacctggccactgcagcaaacttcggcctggacattcaggagtttccatacatcttctgaaatctaggcagaggctcccaaacctcaagtcttgatttctgtgcatcagcaggctcaacaccatgtgtaagctgccaagacttggggcttgcaccctctgaaacaacagcccaagctgtaccttggccccttttagccacagctggagtggctgggacacagggcaacaagtccctaggctgcacacagcaagaggaccctgggcctggcccatgaaaccattttttttcctcctaggcctctgggcctgtgatggcaggggctgctgtgaagatctctgacatgctctggagacatttccccattgtcttggtgattaacgtttggctccttgttacttttgcaaatttctgcatttggcttgaatttctcctcagaaaacgggtttttcttttctattgcataatcaggctgcaaattttccaaacttttatgctctgcttcctcttgaaccctttgctacttagagatttcttccagaagataccctaaattatctctctcaagttcaaagttccacatatctctagggaaggggcaaaattccgccagtctctttgcttaaacataacaaaggtcaccttcgctccagttcccaacaaatttctcatctccatctgagactatctcagcctgaaccatattgtccgtatcattatcagcactttggtcaaggtcattcaacaagtttctaggaagttccaaactttcccacatcttcctgtccttctgagccctccaaactatttcaacctttggctgttacccagttccaaagttgcttccatattttcaggtatctttacagcagtgccccactctactgacactaatttattgtattagtctgttctcacgctgctcgtaaagacatacctgagccttaataatttataaaggaaatttataaaggaaagaggtttaattgacacagttccacatggttagggagggctcacaatcatggtggaaagcaaaggaggagcaaagtcatgtcctgcatggtggcaggcaagacagcatgtgcaagggcattcccctttataaaaccattaatctcaaatctcgtgacacttattcactatcactagaagagcacgggaaagacctgcccccatgattcaattacctcccaccaggtccctcccatgacatgtgggaattatgggagctacaattcaagatgagatttgggtgagaaacagccaaaccatatcatgtggcaaaatatactatgattcctggagatgacagtgataaaatatgggaaaataacttaagtgcctggcaaggggattactggtgggatgggggaggactcaaatgaatactggaaatagtcaacataaatattttcaaatattttatgtaattactatggttgctattacagaaattacccaatgaactaataaataatgactggataaggataaattctaattagcacttgacatgagcatatgggtgcattttaagtttttgcaaagtatatgcgcttatggataaacataactcctaagaaactcttttccaaatggtaagttgacttatccttttcttagtcattatgcctggtgtatcacaaattctagatcaataagatataaattgtagaggataaatggaacctatgctacctaagtcacagttaccagaatttttgctgccctccactgtggtaaaaatagttaaatcacaagaaaatcagttttggtcaaggatgtctttattaaaaattgaatatttagaatataaggtggggttagtatacacttgaatctctatacttgctgcatttccattccatgtccaagttagtagtattttttcaaaataatgactaaagcttttcagtatcttcaagtggcaataaagtattctattacattctaaataatggacttcagaaaataggacagtggacattatagaaaggttttcaacaaggggtggaattgaaacagtggttctctaaatttggcagccatcagaatctcccagagagcctgataaaacacctatttctgggcgtcactcacagaatttctgattcagtagatttgggggtgtgggtccaaaaaattatccttcctaataagttcatatgtgatgctgctgctactgctggactgatcaccacactttgagaaccaccaaatttatagaccttcagcttaactctgttttctctcagatgtccagttaacatgcatcctctattctctgacaattccagttgagattttagtaaatatggctgcatagtttagttactgaggaattttttttggcatataccatttgtcttttttatatattttcacttacaagtttttttttcctcttgatagtatagcaaagtgtgagaaattttgcagtctccttactggatatgtattagtactcagttcattcaggcattcaacatatatcaattgaaaactatctatttgtcaggtgttgtgctagatgctgaggataaaatggtaagctgaatagacatgctcctgacccagtggtgcttacaatctatttgcaaagaccagcgtcaatcaaataatcacacacataaatgtataattggtcagaagagaaatatcatggctgtctgtgggtgaataacaaaccttaattaagctgggaaatgagaaaaacttccttgaggaataaaagcttgaactgagatctgaaggatgaataaacatttaatgcataaattatttgtgaagataagaattttcatgggacacttcacaaattttggcctatataaatcagaaaaacaaataggaagtaagtaaatagcttaataatgaccattaataaagaagtgtacgtaccaggcaccatgcttacaaagttaggaaaattactgagaatgtcttacattccttttatagttgagctcttctgactcacataatataagcaagatcttccagggtttatgttagttgaatggctttaattctggtttgtcatggttgaaaatgaggagttaccacagtgtacatgttgtgcccattcaatatagtcaatgcttaattctccacgtgaaaatcaactttttgtggcttatctgttttcgttttgtttggctgtctcttcttctttttggtgaaagtgtactcaggtgaaagacatgcaataatatcaatggtgaataaccgtaaattaggggagtagttttctgaaaagaagatcttaatattccacaggaagtaaggtagactttttgaatagtcatgattttgagtttatccttttgcttccattcatctatggtgataattaatttgcacaaagttaaaaaaagacattttgctcttttgataaagtatttttgaagtgggcagtaatacataaacctgtactcaaagaaaatattgctaggataattataatagttatatgctcttgtacatcactctttagttaactcatattacctggatgaaaatttactagttgggccctcaatttatatgtgtcaaaaataaactttctgagaaactgagtttattaatacaataaaatctgaatgaaatattattgaagatattagttttaaaataggttttccttagtagcaatcccatttggatgaaattatcccacaggaatgcaattgacaaattccaccttggagttgtagcttgccagtatcttgaagaaaatagtttggaatttgaaaataaaaacaaaacaacaaaaaccaaacctagccttaatgttgaaatgtaaactcttttgagaccctccatattttgcttcttcacccctgattaaactgtttccttgaccatcctttccttcccattccagtcgtcacttaggtttgttccttgcacaaacttctttctaaaagcatgtgtttatttagttttccataaatggaatgttcttccttttaagcatatacaaacaccacctatccttcaagacatagctcaaaccccaacttccagttaaatatctctggtgaaatacctggcttctctgcctccacaaatctttggttttaatccaactctctctaatttcgctagcctttggagtcttccatcagacaattgaggcagtacttgcagtgccttaatctctaaacattacatatagatacaagccatatggactaaaactctccagatattttcagaaaattggacactaattttttatactttgctggctttcctgcagatggtgatggagttatgtgcagcaggttcggtcactgatgtagtgagaatgaccagtaatcagagtttaaaagaagattggattgcttatatctgccgagaaatccttcaggtgagtcttcatacagtcattctcttctgatcttttaagaacctgggagtaatatatacaatgcaccttatacctgctcacatcagatagtttaggtattccaaacataacctgtgcatcaggatatctgaaaaggccaaaaagcttttgagaaagccaatttgcagctgacgcctttaaataagctgggtaacaaactcctttgaaatcatggcctttaatacctctgtcggattaagactactgtgttcagtggatcatggaaatgaccacttggattatttattatgttgttattattttagagttctttaaacaaaaacatagcacaagcatcatagattaagatgaagatgagtcagaagaagtcagtattttatggaatggcctcaaaccaactgtagccttttggcagacaaacattttctttgattactgccccctttttaaatttctttattttccacacccagttggatgagagcaacaatcttcttgatgtaccaaattccatcttttgtgacttcagttcttagggtcatccaagaaggatattaacagaattgaacagtactactcatacaatgttagaatgtccttcctgtcattttggttggattcacttgtgataatagtgtaaatggttgagagttcaaactctgggctgagtttacatttagtttactaaggataagttttattacttggaatctgttacttaatatttccaaggctcactttcctcatctatattataagggtgatattaacaccttcctcaaagggtttctgagaggaattagtaatttactccatgtaaagcacttagtacaatccttggcaaagaataagggctcaataaatgttagcagttttattgttactttattatgaatctccagttagtgtctgaggcagtctcactacagcttaacattgcataccacatcatgggttagccaggtcatgggtaaattttagtggtgaatgggctagagccaaagtgttaagccaacacagattacaaatgctgtaaaatgaatttccacattcccctaaattctcagcctacaaagctgactagaaaatattttggactaaacaaatggttgggtaagaaatagagcaaaactatagctgagctgtgatattcaagatgtccagatctttactcttatggctagttggaaatacggaggctaaaaaggaaggtaaagtggcccaatgtatacaaacattacttttggtgctcttttttttcgtgggtgtcctgatttattttcctttccttatagccaaaagtcatatttctgggaacgggttgtagtgattccagcctaaagaaagaattgtgtctgaaacatcaaaattaagctgtttctcttatcaaaagtttttccaaaaatactaagaactgtaccagaaagaaagaaagaaagaaagaaagaaagaaatatatactgatgtggctttttaaaaaatatatacagggcttagctcaccttcacgcacaccgagtaattcaccgggacatcaaaggtcagaatgtgctgctgactcataatgctgaagtaaaactgggtaagtttattcttatagtattttaagtccaaaacatcttaatggagaaagctcctttaagataactatgctttctatcatgtccctgccaatatcctctacttatttgagctgggttttccctgcctgcaaaaccagtcaaaatttgaaaatttgtttgggagaggaggcggggcaaaagaaagaggatgcacatacctgcttctttgaaatcatgtagataaaacaacttttgaattataatggggatttactttttggccatcgctttaccctctattagaaatagctattatatttatttcaacaattgaattgagtatttaccatgtgcaaatttcgatgccaagggaagggatttaaaaaaataaaaaaattatttcacatgacagagtcatattttctcaagaatatcaaataacttttaaattatgtaaggatgaattgcttctttggattttttcagatatgtaaagaaatgatattgatcagaatcgatgctccaataatatgcaagtcaagttcagaattataaatcaaaagactggaagtacctagctttctatgccagaattcagagttatataatttacttgaaaataaccacacatactttctgattttcttgtccttaagctcatagggaacaatatattgtaccctttaatgtgtaaaataaatatcaatagtttttagaataataccataaaaatcatgtcagtacattgtagtggcagataatcccatggatatagaggataagtcacttgcattatttttcaacagtttgtaaacatgtgtctgaacatgaccttaagatatttcccattttcttgctaaatagatagaacaagagtagagattttgttcattcattaggaacatttttcactgaacatttgtggaagaagcatgaggtagtaattgtttattcttggaataagtgaaagtagtttcaagagagtgtattatttcttttgtgtctgtctaaaagctataaagctagaaacacaattttaaaatacataaggagaggccaggtgcagtagctcatacttataatcccatcattttaggaggtcaaggcatgaggatcacttgagaccaggagttcaagaggagtctgggcaacatagcaagaccctatctctacaaaaaaaaaatgtttaattagctgggcatggtggtgcgcacctgtggtcccagctactcgagaggctgaggcaggaggatcacttgagcctaggatgttgaggttgcagtaaactatgattgtgccactgcactctagcctgggtggcagagagataccttgtctctaaacaataaatgaataaacaatgaaaatgtaaaaaatacatgaagggcatacatacttcacatttaaatacgcaggatagatagttaatcacaaggctaaacactgtgttcgcatatagagcaacactgtcatatacttgtgtcaagttgctggtcaacgcaaacatttacagcacaaaagagaaattgtatgtaaatgaaaaaccactgaaatatctgtcacaatgtccatgcactaaagttcatgtaccttcctctggaggagagaccttctactgctggattagagtttaatcagatttactttacatgtagtccctgtacagtttgttctagatttctcagattatcattattttgaagtaacacattataaaatttaatcacacatattttgcacttaattcttttacaatttgttttaaatttttaagattatagttgtttttaagcaacatagtataagaagaaagtttcagaaagcaaacctaatgacagccaaaggaactgatagaagggaaagagatggaaaaatgattatattgcagttgcaattgctcgataatcttcatattccagcctgtaaggtcatgaaagaaaactttaaattatgccattgttgaggtttcatctcgtcttggctttcatttctctttctcttgctcttttttcttttcttctattaatcagtcttctagtcttttctcctttcattttctcctctggatatgtgccatatagcaacttatggccttcctaggtaattcttggcccctaatgccagttcacagggatagtgagaatgctgggcaattatttaacctgtttctttttaaaaatctagataaaaacatggcacaacacccaatggtgatcttcacaaatattgtggacatttttttgttgttgtcgttcttgttagatcctctaaaactgccttaaactcttaggtttttctttttcctttttcttctcttcccctaaattcctgaagcttctttttagtcagttttgttcgccatcctctggattcctggaaaccattctaaattagaaaatctacttcatttttcatccctgttttattttttctggaataaataaccccagcctacttcagccttttttctgtttctgaggataccataccaaatattttcttataatgtatcccacagatgaatagaagactgaacttttataatctaagctaagatgtagataccacagtaaatacctgcatctgattcaaaaggtctatgtaggaatttaaactaaattctagcagaaaaactcatttttatttatcagtgtgatagagccttctcatatcatgtgtgaggcttcctgatcaactgctaataagttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatctgcaaaataattatttactgagagtctattatgttcggtgctgttaggagctacgaagactatggaagcatgttcttcaagtggctttttataaataatgctttataattgtatactttttgcagtcttccaaggactttcacctgtattcgttatttatttttagtttttagcaccatgtaactgaaagaagtcttaagcatagactatcacaactcaagctaagaaatctatcaactagggttctaaaaatccagttaacctccgaggccgcagatcacctgaggtcaggagttcgagaccaacctggccaacatggcgaaatgctgtctctactaaaaatacaaaaaattagccaggcgtggtggcaggcacctataatcctagctactcgggaggctgaggcaagagaatcgcttgaacccaggaggcagaggttgcagtgagccgagattacaccatcgcactccagcctgggcgacagagtgagactctgtctcaaggaagaaaaaaaaagagaattcagtaaacctgtttaggagtcatttagccagccgttgtatctctagccctgtgccctttccacactctgaagaaaaaaagtactaaacagttggtagtgaagagaattttctagagtctttttctagtcttagtttagtatattccaggaactgctgaagtacacacacacacacacacacacacacacacacacacacacacatatcagtcctatgtaagtgtatgctattgttatcaccattttacttagagtggaattaaggcacagggagttaaaacatttgcccaagatgatacaactggtgggtctatgtaataaaatgtctttatggcaagtttcttttggtatttcaggtaaaacgataatatcaatgcatccaagatgaactttccttgagcttaactccattccctatcaacctgttgtgtagtgaggtactggctggtcagtagctcagattatgtcttcctataatgtcactctataataaagcttcattatgggaaacccataaaagagctctggcattgacatccacacccccagctaaacattgttttgagattctaaatactaccaatttcctatttttaagtgacttttttgtcatctttgtctttgcagagtgatgtgtggtctgtgggaattactgccattgaaatggctgaaggagcccctcgtgagtaaaaaatgtttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaatatttcctaaagtctaatatcttaactgggaggtctaaatgaccagttttcattaagaggtagctagccaactataaataagtaatatcctctatagtattttctgatgatattactgtactgccattaatgggcatgttcagttgtttccccagtaatgggatgaactgatggcaactatttgtgaagtttcttgtgttgcttatataggcagtcagttatatgcagccctgttgattagtacattaaaccaaacacacacagacctagagcagaagacttgttttcccagggcacttacatgccagctaaacttgggaatccttctctctgaagcttgttgatcttgtacctgaaactcttgcttattattagtttttattgctttccctggtagaagtggtgactgtgatttgattgttaacattctgcattggaattcaatttaaccctttccatggattcagtttttatggccacatctgttttcatgggtcattttacaagattagttagtcctggtgcttttaacatcctatttttggatcattatattcattcctctgtagttaaaactgcatatagtcaaatgaaaaatacagagtatgactgctgtgggccgatcaatctagtcttgcagactacatatatcacattaaccatttaatcatcatatctgcacttgagtttttaccaggtacatacagttaactcattgaaacttctactgtaatttagatggaatatgctattgactcttgcttctttttctgaggtctaaatggcctcactttataacgtatgttgccaaactgcaggatatttggcaattgagaagacaataatacctaaaggcaactctctccaaatatgattttcagagaggcatgtgggtggtggtgggaagaggtctgacaggactgagaacacttttttttcctctctttgactcattttttaggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggtagaatctgttaagttttattttactgaaatgaatattcagagtttattcatgtattgtttccaggaaaaagtaatatttgtttaagacttagattgaaaataaaacttctgaggcctttgatatttagttttgccaataatatgccatgtgctcttatttaattttctcttgcgtgtgtgtgtgtgtgtgtgtgtgtgtgtgtgtgtgtgtgtgtgtatagttactaattcttgcagttacacctggcaaatgttcatatttatgaagaccttgaaagcatccaataaagttttgtgatatgccaattttaagtaactaactaaataaaataaataaaagataaaaggtaacaaaatgtatatcttgcttttttttcagctggtattttgactctacaagagataaatggatttgtaattaaccatttattcactgctaattttgaagtagtatttgtgcaccatacaaagcttgttttatgtactaaactccaaatataaaatataattaaaggaactgatttatacaaataaacataaacttctgtctattaataaaagtgaacttctattaaaaatggcaggatttgcagtgagccaagatcatgccactgcactccagcccgggtgacagaacaagacgctgcctcaaaaaaataaaaataaaagtaccaggatggattttcaccaagtccagaagaagcccctgggaagtcctaactttatatattatattacatattccacatttgattttgcggaccataggcagagttgagagtaacaatggaatgtaaaagggaaaacttgaaaaagcaggcatcctcagatcagctgtgggattgattgtagtggggcttgttgtatctatacatgtatcatgttttgaggcaaggagcagcaagaattaatttatttacctatggtaatgaagttattcagccaactttacagaggccagccagtttcaaatgggttcaggaaaaccacacatctatatggtaatttgctaatttccagaattgcaaaatttccaaaatgttacctgtaggaaaagttccatttatatggaagttacactaaagatataaatatagttgccctgaacattttaatataggaaattcaaaataaaactcttgtttgtaatcttctatatttcagtagtcacagtacagctgatgataggaaagaagctgaatgttttcaatgtgtttagtgtaaaacacagaattaagaatttgccttctcattgaaaagaccaaatatcaacctcaagccataaagtccttacatctagagcccacagctgtaagccatgctcaccactatttagagtttctcttgtctcattctccctttgtcccattctctcttcttcctctttagaattgcagaaatcaagttgctaaattttctctgttcagagaaattaatctgcatgcaatagctatattgtgctgcaaaagtgggcctagaaactagaatatggtctacatcacaaaccaagtacttttgaagggctaccttcttgcccttgtaattcactccacatcctaagaagcagagggaacaaggtgattaagtggataacatgcttatctgctgactgtttatgcattatgtttttctcttttgtaaaaaaaggaatacctttgatctttgaaagagaagaagctattaaggaacagtacaccgtgagaagattcaggtgcgttccacaaattgcatatataatttgatgatagcaattcacataaggccgttgattccatactgttgcctttggttcagaaagacttaattctttctgatacaacaaataacaaatctctgtttttaagagatattgagtgaaaatgtgagaattctttattactacccaaagactccttaatatctggcaagtgaagatcaagtagatatcatatttcattaataattgaatacattagtaatacaaatgttacctgcagaatatttcagacatcaagggaatgatttcagaaaggtttactgaaggtatcttcattgcagaaaatgtccatcttttaaagtaaaaacaatgcccctgaatggctccattccactaaaaattctaattgtatgccaatcatttgtgtgtttattttagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagtaagaatttttgatatttttactctgagtcaaaaatgaagagaaaatgtgatagctcatgcggatgttttttctcagtaaaaccaaatgaaataaatattccttgtgttctacagaagatatactaaataatttgtacttcaaataaattttcatgaaatttctagataattgtaactaaatatgataaaaatatttttcagtatctctactgaaatatagctttaattattagttttctgtctattattctttaaccaataaagtgtcaacgaatgcacattaaaaattactattttggatctttaaaaattactttcatagcttaaaatttcaaagataactcatcaaaaataagcacaaaacaaaatttgcttttgttactctaacctttaagttagtttattctttcttccaatagaatgccaaactatactatttgagtgaattacactcatttttgtactacaggatgtttaaatcaaggttaaaatgagaaggcaaagcagtttccaaaatatttggtatatggttaccatatttatgacttgtttcactaatttgctgcccgttttacataattaatcaattatgtggcctcacagaacgtgaaacaatttacaaattattctccgtgttagaagaccaacaggttcgtatgcccactgcatagtaacagaccaattacacatgcatcaagaatgcagcagaagagtttaatgatcagcagggcatggagtgaggaggtggggaggagaccctcaaatccatctcctggaggagttctgggatggggtttttaaggggattgtagagggtgaggtgctggataattggagttgttgattggtcagggtaaggttgatggtccttgaaatcatcaggatgtggaaactgcattttttgatgagtcagcctcttgtggggtccttcagaccagttggcgtcagtggggtccttcagaccagttgattgacaatagtttcactggtatgcaagacctgaagaaatatctcaaaggaaaaacaacatttcataatgttcaagttgttatctacagagcagttaaggggaatgatgatgttgcaacaaggtctacgtgagtctaggaaaataggcaacaaacatctattgaggaaggaggtcagagagcaagctgacctaaagattaatgctaaacgtgctgcaagcttggtatatttttgtttcttcccctctcttcttctgtgattaattttataagttaataagggtggtttcatctgtacccttttgaaatgtggaatacagtgtgttaaactccattttatctaagaacagtcactaaaacgtaattgtttcaaaaatcctttaataaaaagtgaatataattttactggagttattgaatttaatctggtggattctaaactgataatgaagaattatgggcttgataacaaattaatgaggttagataaggttaggggagcagttgttttctaatactccccacatccatttgtgtaaaaggaatcattgtgatgatcctaacttatacccttttatccacatctatttacccaataataatcattgtaataattacaaatgaattttatctgagtatctagataaggaattctttgagtttgtgcacattgagccaattaaacaaatgctaatttgttgacatgtttaacatgagaaaaggtaggagcagcaagagaagcaaggcccaaaagggaaaatggatgtctagttctcagagaaaaagggaactataaggagcaagaaactagatggagaaaagggaggtttaagtctagaatggtgacatttggcaaaaactagctcatctaaaatgctaatgattattctcgatgaaccctagtaatcaattagatctaatgggttttgcatttatgaataagacttttattgatctctgaaagattcagtgataccagcatggcacacacttattgtcatttattgttttaaacatatatgtggaaagccattctaaaatttttaaaagtcaataaataatagttaccaatctcatgactctaggatattgtacaagcatttatatctttatatgtggtcgttgaagaaaatataaaggaaaagaaaattattgataatatagtcaaagtcacagatcttcatgatacctgaaattttattagagttgagagacataggtgggtgctttaagtcaccagcaggaaacaaaaaatgcatttttattaatctttcagttgaagagataatattgattggattaaaggggaaaacagtttcctaaagtcctagatctcaattagggagaaatatttgcaccactgtattacagatcttccattgctcaggaagaccaaactttggttataatagcttgctaaatgtgacagttagtttggtgttatgagtcaatcaagttttaggccagagattcttaacctggaccctgtagatgaacttcaggaggtcagcaatccaccagaaaatatatgtaataggtatgtctatatgcaattttctgtggacagtctatagcatttctcagattctgaaagggatccagaaccaaacactattagaaactactggtttaaatcatttttaatatttggatattattcttttaaattgtgtattattttaaattatatattatataatacatataaacaattcagcattaagatgatgaagttgttcctatcacttgcattttaacaacaattaaaacaattactttcctttttgtttcaaaggacaaagaagatgaatcatcagacaatgatgaagtatttcattcgattcaggctgaagtccagatagagccattgaagccatacatttcaaatcctaaaaaaattgaggtaaatttttcaatatgagttgttgtgacattagtaagaacccagaacagtggttcttaaactttttggtctcagtgtccctttatactcttaaacattgaggacctcaaaaagctttcattttttacatgggttgtatcatttgatatttaatttattaaaagttaaaactgaaaaacatttaaaatattagttcatttaaaaggaatgaaactattacatgttaacataagaaacacatttttaatgaaaaaactgtattttcccaaaacaaaattttagagagattgacattgttttacttttttgtaagtctcttaaatctatcttgcttaatgaaaaacagctggattctcacatctgcttctgcattcaatctgttgccatgtgttgttttggttgaagtatacgaataaaagctggcttctcacatataggtagtgggaaagagtcaattttcatagattgcttagataattgagtaaattattgaataatgtaccaaaactagagaagtggaatctaaaaccatatcaatgaaatgttgtatattcagttaataataaaactcattgatctatcttatgctatgaatagatgttttgcttatgcatgatttttaacttcatgcattgatcagttggaaaatactggttcactttgtatatagatcttcccagacatttacatgtttcattatacaatatcaaaaaacagcatttgttaatgttaccatcaagttcatcataaaagttactgagtgttgttaaattgtcaagtgcttggtgggagatatgtttgaaaattctaattttcctttgcaagctcaaattttatcattgctaaattgtggcatcattttttccccttaaattgacaggtttactttattcattaaaaataaaatgtctaccaaatacccagagtttaaataatcatagtttgtcagtctttctttaagcaaaaatattgtacattaaaaattctggcagtttcgttttgtaacacaaacacaaatatttttccttgattagctctggtctggaatgcagtttgtgacagggtctgggacatttaatctatgttttgttttgttttgttttacaattataagaataattaagttagtcctagtgtccattttgacttctgttttcatgagtatattaatagtatcctatttagaacatatattggtgaggccggagttgtaggttttcttgtctagaaaaggtagcatcatcatcatagccagtattcctaatagccagccatctaaaacaatctttttgtagattgttttgaacaatcaagtagattaggtgagtgtgtgaagaactcaaactcttgccttattgatggtgggtcaggagcctcattgttgctcctaatcagcacaagatgttacacaggagtctactatgaagtcttttatggacaactctcatttttaagtacaattcccctaatactaacagtcctctgaagttaataacaaagagtattgttttataagtactaaccactggcagaaggtacataagccagactgtattatataattagaagaggcaatatgtctttttctttgccttattaaatgactttactcaaactcacaggtaataattattaccttaaacctgacactttaagcaggaaatgtaatgagctgtgtctgatttgaaatacatcattatcttagtatatgctattcttactaatcattttcttctccccagttttgaaattaaatacagccaatttatattaggaattatattttttatttttggccgttacctattttgagtaatttttgcctccagtagtgacaataaacttcctaagatcagcttcataagccaaaagtccccgactgggtcatatgataccaattatatgaaatgaaagtggaaaaaaataggcagatacttaccctcacctacttgtctctcggagtgtagagagagccttgataagccacttcataaagaaaaaatagtttactaaggctactctagtttctagaaagtatagaatgagtttatcagcatgcatatgctagattaaaaaagtaacactcttaaatttcctttttaaagaatctagtatgactgccttattgcatgtcagaatgacctatgttttgggcagctaaaacttctttgagtagaaacctggtgatacaagtcttagtgaggcaaggcaacattccctggccctgtctaccaatgttggcagaaagtaaaattcccccattggtggaagctggcttattatatgcaccctttcttgagtatttggctatattcaatgattgtatgattagtaaaatgcaaattaatctatttagagttgaaacagtacttggaacactaattatgatagtacagtcaaattgtaaagcagaaaaacatactttcttactttcttaaagatgggacacttttgactagagagattttaatgaaatgtatgtatgtgtgtgtgacaacttttgaaaatctagggttagcttaaaaggatgagtgtataagaattagaacttaaattctgagtaagaagtttaaacttgatataaaaagcaatgtgataacatggaaagaacattaaattagaagttgggagacctgcattctgattttagacgttcctttcacttgacataaaattcttagaaaagtcattttccctctttaggctacagattcctcaacaataaattaagattttgattatatgagctccagaatctgttcctatactaaagatcaaatataccatcagaaattatggttaagcaagtctaatgttgtaagtcattatgaaatagaatctgtttattaaaatcatattttataagttagattttaggaaaatatatatgaagacaggcattttcccacaaattaagagctcagtacaatttatgatcaagaattctactgaagtattgcattgtgtctttaaggttcaagagagatctccttctgtgcctaacaaccaggatcatgcacatcatgtcaagttctcttcaaggtatgtgtctttgatttctatattaaaattattcataattatcaaatggaaaattaaaaattatttcattgataatacactttgtgaagtcaactaaaatatccgtgacaacatcatcaccattgactttattggcccacattgaaaaccttaactgcaatgatccattacctatatctttcatatttggtcatactgcagtctctgtgatatttagtttgctaaatagatggcaaggttcacaattttaaaaagaaacaataataacaaatactttgacagtattcaattagtagtcgatgataaaaagacatgaaatttcaagtgaattttcacacatgtgctgcatgataaaacacacacaccaattgtctttaacttcagaagctaatgccacagaatgggtaagcctaaaaatgtcctatagtcaaaatcaaatctaaaactcaatattatataaataaaatatcatatataatattgataccagtcactgtattttttaatctttgtaatattggtgatcttcaataattttcaaagatcacgttccatatgtcagatattgtgtgcattctgttatatttgaaaactaaattttaaggtagatttttttaagaaaatctcaccccctccagccccaactcacaatagagagaacttagcctatattgattcatttagtcagtaaatatttattgaacactcactatattcaagatattggacagtatggccagatggcgtacagttaatgttatgtagtatatattttcttgcttcattactttaaaaaacccatacaattatgtcttcagatttaactggagtgcagaaatcttgaaaaattgtaaagcaagactgcgaactttctttttctctgcactcaatgaatggattgtcatggtcgaactgacctcaaaggaaagaaaccagtttagttttgagtagttggttttggtatcatggaacatgactttaataaaatccaatatataaaatccatacttggtgttaaactcagagtaattgttcactttacaaaaggattttgaatttatgaataacaaatacgttgcctttaaatatagttaaatttaaaaagttaacttaaatgaaactcaaatctttccggaaatttggggccatggaaaaaagtttgtctattccagacctaaatcaataaccaaagtccttcccatatagaaataccaaaataactgtaaaatttagcagcattagtccaaagaaactctctaaatattctttaaatttgaatagtaagaacgaaagtgctctatttttctgtcagtgtagctatctaaatccggaatgggacgttaaaaacattaatttcaagcatttaaaatctggataataacaatagaatatatgacataacagtaacttgtttattatgttaaaatactcacatacactataaggttatgtttattgctgtgttactcaggtaaaatattgtctgaatgttagctttaaaagcttatagaaatttttagaaattaatatatatataaaggaaacatatactctatgaaaacatatttttcttattttggaaatcgttactctattctagacaaaatagcaagtttgggggagaatggaaactggaaattattactcaagttatacttctttttcagtttgatatgtacccatatatttaaacaaaactttgtgttggactttatgttgagttgtacattccctttatgaatgttaggacatggcacatgcttttctgtcttttcattagcgttcctcagcggtctcttttggaacaagctcagaagcccattgacatcagacaaaggagttcgcaaaatcgtcaaaattggctggcagcatcaggtgattcaaagcacaaaattttagcaggcaaaacacagagctactgtttaacaatttatatttcagaagtcaagaaagaagaatttcaagaaggaatgaatcaaaagtgtcagggagcccaagtaggattaggacctgaaggccattgtatttggcaattgggtggtcagtggtggcctttgagaaatggaaaataatttttctgaattttcttctttttgttgggtagtagttaggaatgtgtctaagaaggcggggggagtcagctttattaggtttctataccacgtaagaaaagtatggtaaagaaacttgagagagacctctccagcaggctaaaatttataggtagcaattagaatattgtatggaggagttgtgagtgtgtgtttcatttatcagttggttacttcacctctccaaaataggacaatatctgataaatatccctaaatgttacagagtgatggttttactcaaaatacatgaacaattaatctatcaaatcatagaaaataacttcaaaagttgtgatgtgaatttcaaaaaagtattttaagatgtgcttttgagagagtttaaatgaattatagatttatgaaatattaggataaacaaagccaaaagttgtgccatggatcatgcaatctggcattatccagttttaagcaatccaggtaagttaagcaagggaaaaatggctgattgagttgctgatatgtaaaaatatagtatactgattttattaaaatgttaataataaaaatgatacagatgtacttcactttttgaaaagtgaatatttgaagatcaaaacttaaaacacattattcttcttaagtgactcagattatggcagagttcttttaaatagcactgtctcctcatacacaaatactatgttgtgaaaattagataagcctgagtgaaaagcaaatttttaaaaattttttcccagagtcttttctttctggcttgactatggctaattttgctaatacagggcaaacaactaaaaatttaaggtttattcatgtggcatctttgaaataaggaaattctggattagatcccaaagcagtcatagcattgatagaagggagaaggcatctgtgcagataatagctaaatgtcttttcagctccaaatttcttttattttattgtttatgctacatagaccatttgatattctcatgaaattatatgcttcattatggaggaaatctcagagcaccttactataaatttgtctcagaatcttagtgcactcacttgaacttatttggtctactaacataccaaaagacttaaaagaaaatggtttcctgaaaaaaaaaaaaaaaaaaaaaagcacaagtacaacagtgtcagaagatggggacacaaattttagcatgtgttcagtgtaatgttctcaaaggacagcagtatttgcaaatatatgtcttttggagttggagtatctatactttggctatgtataccaagactgaaaataagagggacaatagtatttatcttgaaaatctaagcacacaaaaacattaaacagggacctgagttttctcttagtgaagctttttctaagtacactcacccagacctgaattttgagcctgttaaatattctcaccagattttaatcacaggggttatttaccataccacaactcaatattaaaacctaatctccaaaccagatacatttgtattttaaatggaaatatttacactatagaattgagctgttcaatgtggtagcaactagcctcatgtagctattaaaataaaaagtaaaatgaaaattaaataaaatttaaaagtcactttctcaggcacactggccacatttcaaatgctcagtagtcatgggtgactaatgaccactgttaatggacagttcagatacagaagatttctatcactgcagaaagttttgttgtacattgctgctataaaaaggttcccagctttatagaaacgggtgttatctcttttcagtagttcactcctcaactgtattgaactacatctggatatatcattgggtggaaatatgtgggggttaagattgaagaatgtaaatttgtttgagttcattgtagattctggatattagccctttgtcagatgagtaggttgcgaaaattttctcccattttgtaggttgcctattcgctctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgaaaggaagggatccagtttcagctttctacatatggctagccagttttcccagcaccatttattaaatagggaatcctttccccattgcttgtttttctcaggtttgtcaaagatcagatagttgtagacatgcggcgttatttctgagggctctgttctgttccattgatctatatctctgttttggtaccagtaccatgctgttttggttactgtagccttgtaatatagtttgaagtgaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctagccatgagcatggaatgttcttccatttgtttgtatcctcttttatttccttgagcagtggtttgtagttctccttgaagaggtccttcacatcccttgtaagttggatttacaagataaaaacaaacaaccccatcaaaaagtgggcgaaggacatgaacagacacttctcaaaagaagacatttatgcagccaaaaaacacatgaaaaaatgctcatcgtcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttttagggacgtggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggagtggggaggggtagcattgggagatatacctaatactagatgacgagttagtgggtgcagtgcaccagcatggcacatgtatacatatgtaactaacctgcacaatgtgcacatgtaccctaaaacttaaagtataattaaaaaaaaaaaagattgaagaatgaactctcctcttgagggttttggctagtctatcatcttctaataaatacactgtcgggcttttttttctactggtcagtatgtgaggccagtggtactcccagtccttcctactcttgatacatttttttaaatgtatctacctggctatcagttggactatgtatcttcttacatagatagagatatttggtaagtgtacacttaatattgaaaacagagcagccatgtaagtctacagatggaagaaaacttgaacccctgctaatacccctgaaaagagaatttaagatcctggccccatgagaattttcaggtgatacttcctgaatggaatcataaaaatgaccaagaaaaaaaaaaagaaaaaaaaccaagggatttaactgatacactatacatatgaaggcaatggctgtaatcaccattgttactaatgtgtttttggcattccatagaatcttcttctgaggaagaaagtcctgtgactggaaggaggtctcagtcatcaccaccttattctactattgatcagaagttgctggttgacatccatgtaagtttccatcttaacacattaatgtctattattttttattttccatttattttgacttacacattctcatattcacttgagggaaaggttaaagagtttagttttttaattaacattttaaggatagattctcattgctttgtgaatacatagaacacaaaatctagaaattaaaattgaaatgggaaaacatttaatcaatcagagaatattttattttcacattcttgtgtcagttagaacatgtctgggagagtagtgataacaagctgtttgtaaaacctaatctcagattgaggggtacaggttagatgtccaacttttaatagcattccttgagtgatgaggcaatgcataaatataaaacatttagtaaaaaacagagtgtcctctgactgcataaataaaaagtcttccagctctttgtgaacatgtttaaattgttctaatgcagattttaaattgtcctaatgcaatgtgctttcagattattctatttcaattttgaattacctctatgctaccgtacacacatcccttccagattgcccaaaagttgttaaatgatacataccatacttaaaagatggatttagattaatttgcactttggaagtgtttgagatactttaagacaacccatggcacgtaaaacctgagctggtaaattaacatatcaatttcaagagctgtgtgttaatcccaatgtcaggggataaaacaaaagggaaaagttaccatttttaaggagcatcaaatctcctgttctctccagcatcaaaagcaagtgtccattcctgagctgacaagtatgggtattttttttaagtgagtaaattttgccctatgtgatccagaaaggccactaataatcacagtctgatgtttgggttttgacatctcatcctcactaaaattttggctccatctaatgagtgaacatccttgtttcagtttaaaatatatttcaaaatgttgtcagcttggaaactttccaatctagaagaaaatgaaagctactagaggctacattaacctttcttgtgcacacaggttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaaggttggtttttttgaattacttatactctccatgttttatgactgcagagctatttgcatttttggtttattttcaaaatttattaccaagagagtgacctaatttcacttgcattttagtaaatagtttgattgtcaataatgtattttaaattgttctaatgcagaacatctaattttgtgtcatttgtgtattttaaaataagcattcaagtatttattagtttctttataactggaattgtctagatgcttatgttaaaattactgccactgaatcatcctactctataaaactatactgagtatgagaaaggacaacaaagaaagtgtgtaacttaacaagcataagatgaagtcttggtatttgcaaacatagctattcatttctcaaacttttgtgatatcactatatatatatatatatatatatatatatatatatgtgaaatttaagatgatctttatctgtttaattggtggagaaattaccaagagctcttttaattttttccaaccaaaaaagtctatcaagaattccattatgaaataaatttacttttagaattaccacaggcacgtatgtttaattttgtttcctatgcaaaaagagagcattggcacattttgttaagcttagtatttttagcaattaattaaataacttagttccacaagacatgaggtatgtattgctgaacttccttggtgggagtagtagaccaatggagttctatagcaaagcagtcagtacacatgttagaaaatcaaggcacatgttgaaatgaacacaaactagatatactgcaagaagaattaatcatgttgtggttgagctaaaacataggcttaatcattcatgtgtctgtgaagttgctaatgcatgaaatagtatatatttaagaaaaaaactacatattcttgctgttaacctaatacacgcacctaacaaagaatacaagttctcttccctctgccatccaaatgcatctgagaaattggtggtggctatggctttaatcattacataagactgagaagacataggggcatttttatgttctttatcataccagtagtgttcacatagaacaaagacaagcctgggcatggtagatatgtataagacacatcctaattctgttgtacttgctaactttcaaatgtgtttttattgcgtgactttctttcattaattggagcttgttgtcagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggtaatgcaccatttgaaaagcagattgaactcctctcattgcgaatgtgtttcttcatgggacatgtagcatttctagccattccaaatagattttcatcatataccccaaggccttaaacatttttaattataggtttgtaggtggatccttattacctctaatttgggtggttcctatttacttccaaagacaaaaatctcttatttgtttgcctttattactcagatcacatatttgaggtagtgtctcttgacacacactttttaaaaatattttaaaaaattaattgacacctaataattgtatatatttatggggtacagagtgatattttaatatatacaatttgtaatgatgacatcagggtatttagcatgtctatcacctcaaacattcatcattttttttgtgtgttgggaacaatcaatatcctctctcctagctatttgaaaatatgtaatgaattattgttaattatagttaccctatagtgctatagaatattagaacttatatctcctatctagtcatgcatttggatcctttaaccagcctttctctatcactctcccgtactcctcttcccagcctctagaaacgactatttactctctagttacttgagaccaattttttagcatttgcatatgagtaagaacatgtggtttttatctttctgttcctggtttatttcacttaacattgagtccaggttcatccatgttgctgcaaatcacaagatttcattcttttttatggctaaatagcatttatttctgtatatatgtcatgttttctttatcaattcatctcttgatggatgcttaggctgatgccttattttggctattgtgattagtactgcagtaaatatggaggtgctgatagctctttgatacactgatttcctctttttttgagatatgtacctagtagtggaattattggatcatatggtagttctatttgtagttttataaggaaccacaataccattctccattgtgggtgtagtagtttacattcccaccaacggtatataaaagttcccttttctccacatcttcaccaacattaattttttatgttttgataataaccattctaactaggatgagataatatctcattgtggttctgatttgcattttcccgatgattaattatgttgaaattttttttcatctatctgttggttatttctaagtcttttgagaaatgtctattcaaatcatttgtccattttgtttattatactttaagttctagggtacatgtgcacaacgtgcaggtttgttacatatgtatacatgttggattatttgcttttttctgttgagttgtttgagtttcttacattcaggattttaatcccttgttggacgaagagtttgcagatattttctctcattcttcaggttgtttcttcactttgttgatcatttccttttctgtgcagaagatttttagtgtgatataattctatttgtctatttttgcttttgttgcctgtgctttggtcctattcttttttcccaaaccaatgtccacaagcattttcttatattttctagtagttttatggtttcagatcttacatttaagtctctaatctattttgagttgatttttttataaggtgagaaataggggtctaatttcagtcttttgcatatggatatttagttctcccagcaccatttattgaagacattgttctttccccagtgaatattcttgatgcctttatcaaaaatcaaccacaatgagataaatgaatatgtggatctatttatgggtcctttataccgttccattggtatgtgtgtctgttttttggttgctgtagttttgtagtatattttgaaatctgatattgtgatgcctctagtattattctttttcctcaggattgctttggctattctaggtcttttttggttccatgcaaattttaggatttttttcctatttctgtgaagaatgtcattggtattttcataaggattgcatagaatctggatattgcttgggatagtagggtcattttagcaatattaattcttctagtccatgagcatatgttgcctctccttttgtgtgtgtgtccttttcagtttccttcatcaatgttttatagtttttcttgtagagatctttcacctcattggttaaatttatttccaagtattttattttgtagctactgtatatgggattgtttttgtgatttctttctcagctaggttattgttggtatgtacaaatgttacagatttttctatgctgattttgtatcttgcaactttactgaatttgttcatcaattctaagaattttttggtagtgtcaaaggatattctatttataagatcatgtcatctgcaaacagacactctttgacttcctcttttccaatttggatgtcttctattgccttctcttgccaaattgctctgattaggacttccagaactaagttgaataagagtggtgaaagtggatatttttgtcttattccagttcttagaggaaagaatttcagcttctctcattcagtgtgatgttagctgtgggtttttcatatatggtttttattgttttgaggtatgttacttccatacccaaactgtggagagtttttatcacgagggaatgtagaattttatcaaatgctttttttggtatcttttcacatgatcatataatttttgtctttgattccattgatgtgatgtatcatgtttattgatttgcatatgttgaatctcccatgtatccctgggataaatcacactcaatcatggtgtataatatttttgatatggtattggattcagtttgctagtattttgttgattatttttgcatctatcttcatcagagatcttggcttgtagtttttgtttgtttgtttgttgtaactgttgtgtccttatctggttttgagatcagagtcatactgacctcacagaatgagtttggaagaattcccttcccttcaacttttttggaatagtttgagaatcgacattagttcctctttaaatctttggtagaatgcagcactgatgccatagggtactggacttttctttgttgggagactttttattgctgattcaatcgcattattcattattggtttgtttaggctttctatttcttcttggtacaatcttgctaggttgtatgtgtccaggaatttctccatttcctctagattttctaatatgttgctgtgtagtttttcataatagtctcttatgattctttgtatttctgtggtatcagttgtgatgtctgcttttttgtttctgattttatttgggtcttttatactttcttgttagttaatctagctaacggtttgtccattttgtttatcttttcaaaaagccaaatgttcatgttgtatttcttctgtattgtttttgagtctcaatttcatttacttttgctctgatttttattatctctttatttctattaatttggggtttggtttgttcttgcttttctagttcattgaggtgcatcattagattgttattcaaaatctttctacttttttaatgtagtcatttattgctataaacttgtctcttactactgcttttgctgtctcctataagttttggtgtgctgtgtttctatattcatttgcttcaaataatttcttaatttccttcttatttattggctaattgatgttcaggagcatatatttttaatttccatatattgttacagttttgaatgtttctctggttattgatttctagtttattctattttggtcataaaggatactcaataataatgttgatttagaaaaatgttttgagacttgttttgtgtcccaacatatggtcagtcttagagaatgtttcatgtgctgatgaaaataatgcatattctgcagctgttgggtgaaatgttctataaatgtctgttaggttcatttggtctatgctgcagtttaaatccaatgtttctttgttgattttctgtgtagatgatctgtccaatgcagagagtgaggtgttgaaattctcaactattattatattgtagtttatctctccctttagatgcaataatatttgctttttatatctgggtactctagtgtttggtccataagtatttataattattatatcctcttgctgaactgatcctattatcataatataatgtccgtgtttttctcttttttacattctttgacttttaacacctgttttatctgatataagtgtagctattcacgcttgcttttgatttctgtttacatggaatatctttttccatttcttcattttcaatcagtgtgtgtcattacaggtaaggtgaatttcttataggcaacatataattgggtatttttatttttttatttttattttttttactttttaactgttctactagtctatatgtttaattacagaattttgtctgtttactgtcaagtttattattgatatgtgaacacttactcctgtcatttcgttaattgtttctggttttgtgtatccttttttttctattctcttattgttaatctatgttgttaggtaatcttttgtagtaataaggtttgattcctttctatttcacctttctatacctgctttacaagttttataatttcatgttttcatgatagttgttattgtgtttttcctttcagatgtaggactcccttaagcatttcttgtaagacctctctagtggtgatgaattcctctgctttttgcttatctggaagaggctttatttctccatttctgaaggattgctttcctggtgatactattttgggctatcaggttttttccagcactttgaatatatcatcctattctctcctggcttgtaaggtttctgttcagaaatctgctgttagtccaatgaggatttccttatatgtgataagactctccttttgctgtttttagtattctctctttgtcactgacttctgacagtttcactgtgattttctttgggaggacctttttgagttgaatatatttgataacctttgagcttcctgaaactagatgttcatatctctctcccaagacttgggaatttttcagcttttattttattaaataagttttctacatcttttcatccttctggaacccccataattcaaaaatacatcctcttaatgttgtcccataagttctataggctctctttattctttttttttctcttttttcttttctgcctgaatcattttaaaagacatgtcttcaagttcagaaattctttattctgcttggtctagtcagctattgaagctctgtattgtattttttaatattattcattgaattctttatcttcaatatttctgtttggttcttttttaatgatacctattcctttgttgaatttctcattcagatcatgattttttaaaatttcattgatttgtctatctgtattctcttgtatcttgctgaatctccttaagatcattattattaattccttttctggcacttcactttttcttttctgttgggtctgctactggaaaattattatgttcctttgaaggtatcatgtttccttatttgttaatgtttcttgtgtccttgtgttgatatctgtccatctgatggagcaattgcttcttataatgttatggagtggctttcataaggaaagacttagtccatagatgggtcctggggtgttggttgggttgggtgcattgactttggttctgggtggatgcagcagtgtggtctctatgctgtaatatacattagcaacgtttgctagtacctcactggcccaggctgcaaaagtttgtggcagaggtggcacacctttgccaggggtgggcttgccaggctgtttctcagtccagaggcaaaagtgcacatgcggtgggttgggtggctcaggaatttgccctccagtgttgagctatcagactacttctctgggcaagagtgtggtcacacagggtgggaaagctagcttggggtctggcttactgggatcagtgctgctgagctgtttctctggccagggttgcaagtgcacagcagttaagccagcctagagttggcttcgccaatgtgcagtactggagttatggctgacctttcctgggcccaagatctgagcagtcagggtcacagcatttcagccatcagttggggcttggtgaaatgacagtggagctgcaagactggagaggcacagtgtttactggcccccagaacatagtgtatttcagcagtgcctctagattcaagatggcaccaggctgcagcagcttaggtcatgggttggtgggaaatgcacaacttttgctccttatctggagcaatgcagacacatgaatttcaggcaccttcccaaactgaactcagggcttgtgaggactatgagattctcctgtagtaagtactacagttgtctgtggtggcaattggggctgatgagagtcttctgcttaccttttcccaataaggagaatttattccgggctctgagctgatcatggtaggggagatggggcagcagaagcagagtacctcacttccctctctttgctgccattttgagattccatgctacacagtgacctcaccaccccatcactgcactccaacactctccctcagacacaccagttgaactctgtttattcattctctttgtccttttttgtgagggggacaagcaccaggtgccaccaataagctatcttactgacatcactccaactggaaccgattatttttttctgagtttttttttattgtagtaaaatatgcatatcataaaacttaccatttcaaccatttttaagtgtacaaaccagttggatttattacattcagaatgttgtggggttgtcaccactatccattttcagaacttattttttttaccatcccaaacaaactaaacaattaagtcttgtttcccccctcctctaacccctgataacctctattctacttttttttcttggtgacttatataagtggaatcatacaatatttgtccttttgtgtctggcttatttcactttttaggttttcagagtttatccacattgcagcatgtatcagaatttcattccttttcaagggtgaataatgttttatcttatgcattcaccacattttgtttatccatttatctactgatggaaacttgggttgtttccaccttttggttattgtgaaaagcgctgctgtgaacattgatgtacaagtatctgtttgagtccctgctttcaggtttttggggggtatatagctaggagaggcattgctatatcatgtaatcaggctatgcttaacttcttgagcaactgataacataaaattttaattcaagaaatatactgtgtttagacaatgattttgtcattcacaaaacatttattgactttataaataggtttaaaatattcaagtagttcacagatgctacatcaatagaaattatcacacataatattttctgaaccatgtggtatttgaactcattcttgagaaatggggagtatctggatatctgaaaacacaggtggaactccagacagaaaaaagattatgccagtctactcccctagcctattttcttgtcacacaaactggctttggagatgccatgctctttcatgaatcagcgctcctgtgcaagctgtttcctctggaaggctgccccctcacctcttctctgcttggtaaattagtaatccttcatgggccaaattaagtatcaactttgacttcccaaggcagagttatatatcccttcctttctacttacaaaccttttgtccatagttccaatttagtacttatggtattattgttagttattttatttttttgctttcatactatattgtgaactcttaaaggaaataattatgtctaatccttccatgattatttgtctaccaactcacccaacttcagtgtctaaccaaggacatggcatatgataggcacacagtaattatggaataaatcaataaagtttgaaaagaaagaaaaaaaggaaggaaggaaatttcctggatggtttctaatgggaaagcagtgtcagtgggaaaatatctatgtctgtctatctatctatctatctatctatctatctatctatctatctatctatcttaattaaagacattaaaacaggatgtcccaacataagtttcatagcaaccctggttatatccagttatctcaaggaatgttttggaaatttatagaggaagtggatcttcctttcattttaatttaaaaaggacgtgatgtcataccatgtttttgtggttgaaaaggtcataaaaaccagtcttttgcagaatagcacagctctctcagtgccaagaatcactgtttagacacaaagatgagcttatcaacagaataacttaccaacaatagttgacatattttcccacaggacagggcataccacataaattgtcacatttcgtggcttttatccttgagtatcttctttgtaagttaatggaagccagctacattttcagtgatgcatgtttacgctcttggatttgtgttggttgatttgccttcattttctttatcatttgaaaattatttatgcaggtttttcatgctttcagttttgtgaagataccttaaagcagtagaacagacacccccacactgtgctttatattttttcaagaggctgtttggcatagcatagctggatgtatgctttggaatcagacagactttggcttcaaattctgcttcccctacttactagtactatgactgaatacattatttactgtctctaaattttaaatttgtataagtaaattggagataattatacttacttgttgggctatggtaaggattcacaaagatatctaaatatcatgcttagcacagtagctgatacatggtaaaaattccacaaatgttaggtctcaaattgtacagttgggaacctatagctccttgcttttctcctgtaccatcagtcatctcaataataggttagttttctccttctgatgacattgttgagtttttctagtaaatgtggattttataagaatgtagatgttatagatcttgcattgtgtttttcaaacgacccctcactaggcatatttctcccactgttaacctactaatgaaataaaaattggtttttggacttcttttaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatctgtgagtgtgttcaatgtaatctctaaatgctactatctgttcacttattaaatagtgtttaaccactgcttcatgatctgttaggaatcaaattattctcacattcacttgaaataaattcagattgatatatgcttttaaaacatctactctttactgaatctttatggtacctaaatttgagctacaattgagaaattgagtcccttatatggatttatgtgtgttttctaatcacaataacttaaaatatattcgtgttcaacaatgtattttagccatcacgatttgtgttatctgatggtttcagagttactgaaactatacttccagtaaaaaataaaatacaataaaaggaaagaaatttatttgtttttttattttgaaataagatctcgctctgtcacttaggctggattacagtggcaggatcatggtacatggtagcctcaacctctgattcttaatgatcctcccaccttggcctcccaagagctgggattacaggtgtgagccacgacatctagccaaagaaaataaatttggctaagtcgtgtctcatttgcggaaacactgtagcatataaggtgtacagaggagtaatttaaaaaaaatttttctataactccatcaggtgcagatttttctttaaaaaaaaattctgtaactccatcatgcacagaactagtaatttcccttattatcttccccttacatctttgcagtatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggtgagtttgttttgttttcttaaagaatatatttttatgtagcaaacctgtgaaaatcatagacataaaatatttgcttactcttaccaagtcattacaataaaaatatatttatagtagttaatttgctcagaattggttttgctgattttttttttcactcagtgcagtttgatgtttgaattgacggcccccacctttgtattctatttcttttaaacctgagttaacttggatggcaggtggatcacgaggtcaggagttgagaccagcctggacaacatagtgaaactttgtactaaaaatacaaaaaaattagctgggtgtggtggcaggtgcctgtaatcccagctacttgggagactgaggcaaggagaattgcttgaacctgggaggtggaggttgcagtgagcagagatcacgccactgcacttcagcccgggcgacagtgcaagactctctctatatatattatatttattatattttatatatatatatatatacacaactggactaggttatgattgtttgaaagtttaagtttcgtatttctaatttagggtagtgttcaacatgtgatactttatgaggtattccaagaaatatttctgcaggatcttgtttttaaaaagccttggaaatttgtagagaaagttccttctataatgtcttaactctgatagactttttaaaatcctttttttcagaagaattataaccacattggcaatgctgagacaatattttaccgcaagccaatctgaatcataaatgaaacaaaataaatgaattcaagaaagggagaaatccaaagtaaatgccaacctctgtcttgcaatttcatagattttgcttaatgtatgattgaacaaaggacagggttttaaattaaaaatagaaaagggtaacaaacattgtaattatgtggattaaagaatttttaaaaatcatctcaaagttctgctaatttagtgtgtcaaacaacaagatagcatgaatatttcagtctggcaactacctagaaatgtagttaatgtctaataatccattcttataacgtgtaattttatattttgaaaaataaaagattatagtaaaaattggctatacttcttcctccttctctgattcccctgtgagaagaagatgcagctcctaaacatgccattggccatgagttagagaactgattaaagacagagtgagaaaatgaaggcaaaatcacttaagttttctccttatgctcatggagcacaggtatgctccaagtgcaaggaggactgtgaaattttatcttgttacattacttggctggttatttcctatgtcactttatggtgaaaagctcccatagtagtttgaagtgtaatttaactttggttctgtcttctatttcagtcctcttatttggtctttaaacagtgcttatatttgaacaaatagagccagtcaacaaataaaagagagtgtagaaattgagatccatgaaggcaggaactaatttcataggcatttggcaacggtaaatttttaatatatgcatgaacatagaatcattcaatttaaaaacaattatttacatataattattttaaaatcattcaaacatttacttatgtttagagatgagaaatgagctgaattgaactctttgtatgtgctagactaagaatgtttaatgataattttcaaaaaggttgattgattttgataaagttcagaacactactaaagggtgctaatatatccataaatttccatttgtgagatggcataccagatgccagccagtggaatactgccagagggaattatgttctatatttttatgtatttcattgaaatttgttctgttggtagagagtacatagttacacagtatgaggtgaatatagcctaaactgataagtcatctttacatagatcagcatactggaatagcaaaaatagtaatatagatgcaattatgaaaaataatatgaggtgaatatagcctaaactgataagtcatctttacatagatcagcatactggaatagcaaaaatagtaatatagatgcaattatgaaaaataatctgagctaatatagcactttttatatatgaacaggagtcaatttgctgttgggaacccgatctaatctatatctgatggacagaagtggaaaggctgacattactaaacttataaggcgaagaccattccgccagattcaagtcttagagccactcaatttgctgattaccatctcaggtttgtttaagaactaaaattagctgagtaattatgcagattaattagtctgcaaactgggttaaagactttctcaggttaaagtgttcctagaagagcactttaaatataacctttaattgggacaccagactttcctacttatattatcttatctatttacaatttaaagtaacttccttttattgtaaagtacctaacctaggttactgataagaaaaaccacaacatttgcatccttgcatgttctctccagtgcagcctcctacaacttcagatttctaattttcatccattcatgcacaggactgcatcaacatccaccatgtcccgttcttgtgaggtgttagaagcaacaaagaacaaagtgaacaataatcagatacaaaagagagttgtccttagtatatagccttatcacaagggcctacaggtagagtttgtaacaagaatggatcccctaaagatctttacaccttttccaaatagtagttaaatttcttagttttggtcagtcagagcctgaaacttagaatacaagaaagcaagtaaatgagtgttaagagtgatcgtgattactaaacagcatttagtatcaggaaagcaccaacattaaagctgactataggcaaaagatgactgacaaaagagagaaaaagtaagaaaatatggtttgtctatgtgaataaaatgatgctaatcacagacacttatatgagtttatgtattttattatatataacatgctttatatataattagtgcacaaattgccatgttgcacactaatgattttgtgttattcctaaaatgattaactttgctttacattttggttagaggagaaatccctttagaggtatgctcagacttcatgattttttaaatcatgttttatagttagttgcttataattgtttaaggtacgtagaagtaatatttattttttgaaaacatctgggtggcttatagactacatatctgtataacagatttctttactttttatccaacttcctctaacccaaatatgttcttctctagttcttgagcttctctcaaatgtggaatatttttccatcaaacagtactgagaacatcagtataagaaggtactcagtagtttaaagcacaaatttattttaccatttaagaaatagaatagcggtagtgttttagtccattctcatgctgctataaggacatacctgagactgagtaatttataaaggaaaggggtttaattgactcacagttccacatggctggggaggcttcaagaaacttacaatcatggcagaagggaaagcaaacatgtccttcttcacatggcagcagcaaggagaagtgcagagcgaaggggggagaagccccttataaaaccatcagatcatatgagaactcaatatcatgagaaaagcatgaaagtaactgccccatggttcaattacctcccactgggtccctcactcaacacatggggattactatttggattaaaattcgagaccatatcacatagatgtagatatctgaaccctaacactgcttcaaaaatgttgtgtaaaaacatatgaaagactaatcacataagtaagaatcctattgttgggcctagaaatcatgtaataataaaccataaaaatgacaaagaaaaatgattataaagtcactatataggggaaaagaaatgtgtgattttttcatggcctgtgtttcctgactgaattgtaagaatttgatgaaatttacaattaggaaattaatattaacgataaatttagttggaggaaaatataatgaaactgttcaactattttacaagcatgctggaatgacagaacacaaagatacccatattgctgtccctgaataccttaacagtcaatattcagccacccctctcgtacacacacactaccagggacagcttttaggtctctgaactccagaggagttatgacttcatgaatagccaaggtacaaatgaatggatggtaattatcttgcctgcatagtggaaggcttaacttgtcccaaaaaaagtttagatccccttctgagaggcacataggtagatactttgactatctcttggaattgagagactaaaataatctgtcatatttccaaatcctgaatgggagattctgatgcaatgcagttttttttaaggtgctttttacgttaataaagatatttttaaaaggcaaaatatctttacttttttttcttctaatatatgaaaagaaagactgattttaaatactgtatattttcttatctatcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtccgtaagccacatttcatgtttactacagctatataaattttgcatcctttcatttggtgaactacataattatgaaaggcaaagcagagaaaggaaacaatttgcagtttcaaatacagacgagatcagggacgttcagggtggtatggctatagacagcaacttcaaatcaaagaagagtaaatttcactgacacatcttccaggtcttctatgttacaatcttgatttttttttttgagaaaacattgactgactaaaatagttattgatgttaggtttggtttacctcctcaccttactttctttcccagtcaccccgaatattccagataaaccgatttttttttcctgcctttatatagcttcagctatataaatggtcttgatttatcttcacaaacttggggagatgcatatgatattctctttctttggagcaacagtaagattgaatccctcctaatactgtccaggaaacttaatgatgagtcagaaagaaaattctgtgatctgctggctctcactcccactgttgatattaatgaatataatcactaattgttttccatctgattagaatgttttcatataccctgtatcttcacaaccatccactgtgaaaggatgtaacaaccctaggggttcagaatcctgctctcagctataaaaaaccgtgagctaatgtcatcccattctgttctatttctgaagcaaatccccctgtactctcagccttcttttgcttctttccctcttcattaattgcctcttcaggcagaactggtggcataggtgagaaatagctggaatcacattatataaattgcaatgggatatttctgtcctgactgaccattattgttctgcatataaagtgactttctcagggtaggtttttgtatgtgtgtgcatatgtacacatacaccactaaagagggaaatgagtacccagataatttaagcattaaataaatacactagtttcttccaggtttaggtatcactacttccctccaaatcatattatgcaaatgtgatagtcctacaggtgaaagatatccccagatgttaactcaggagtttatatagcaaaactacctcctcctaacttgtaaaatattagttcagtaagagatagtcacaaagttactcatattgcaaatctgtgctctttgtgaggggtggactagttaagtttagttttcctggctgaccccattccagtccacctaagctctcagaacagcaaaaagcatttgtcccactgacaggtggaattagtagcatcttcacataggaagacaagaacaaatcatacttgcctggtattttcatagccttccaagatccacaagacagtgaactgtcaccaattactaccctatattaaatatataggaagtgttttcttaagagagaatattttttattattggaggattagtaatcatgctcctttgacctacttgggagcaatgcaaaagaaaatgcaagagtaagctagacccagagagagacagaaagagagagagagagagagagagagagagagagagagaatgcgtagggatggcagaagaaattgcagccaagaaagggctttatagcacaaagtataaatctatcgggtaagacaacatattccataagaaccagaagggctaatcaagagcaagcatatacctatttatactttttaatttaccttttaaaataaccctattgaaataatgtacataccatgaaatacacttgtttaaagtgcacaattcaatgggttttaggaggtctatagagttatgtgacaatcgccatgatctaatttttatcatccccaaaagaaaccccatattcattaacagttacccccattccatccttctttacttccccctctaccactcacagtcctaggtatccattgataaactgataaatggttacctaggactttctttctctattgatttgcctcttctggactattactataaatggaaccatatattatgttgtgttttatgacggacttttacttagcataatattttcaaggtttgtctatgttatatataacatgtatcagcaattcctttttattgctgagtagtattgcattgtatggatataccacattttgtttatccatacatcagttgatggacatttgcactcttcccactttttggctattaaaaataatgctactacaaacatttcatacatcttcatatgtggatatgtatggtttttttctcttggatagtatcgttacactgtttttcaaagtggttgcaccgtttcacattgctatctgtaaagtatgagagttctatattctctatatccttgtgagcacttgtaaatatctgtttttttattctagccatccccatgggtgtaaagtgggatgtcataaaagtttcaatttgcagttccctcatgattaatgttgttgagtatcttttcatatgtttactgaccatttggagacatgtctattcaagtcctttgcctgttttttaattggtttgcttatccttttgctgttgaattgtaaacattctttaagtattccatatactagagtctttttttcttttgaggcagagtctcgctctgttgctcaggctggagtgcagtggagtgatctcagatcactgcaacctccacctcccaggttcaagatattctcctgcctcagcctcccgagtagctgagattacatgtgcttgccaccacacccagctattttttatatttttttttttagtagagatggggtttcaccatgttggccaggctggtatcgaactcctgacctcaagtgatccacccaccctggcctcccaaagtactgggattgcaggcgtgagccactgtgcccggcccatatactagactctcatcagaatatgatttgcaaatattttctcctattctgtatgttgtattttcacttccttgatagtttcccttggtgccccaaatttttaatttttgatgaagcctaatttatcttttttttccttttcttgccttatatttgggtgtcaaatatcagaattcattgctatattcaaggtcatcaagatttatccctatgtttacttccaagaattttattgttttagctattacatttaggtgtttgatcaattttgagttaattttgtatatggtgtgaaatttggactccaaccttattgttttgcataggtatatccgcttgtcccagcaccatttgttgaaaagactgttttttccctattgaatggtataacaccattgaccatagatgtatgggtttatttgccaactcccaattttattccattgatctatatgtctctccttatgttatttagtaccatactgctttgattactgtaacttgcagtaagctttgaaattggaaagtgtgagttctccaacttagattttctttttcaacattgtttggctattaggagcttcttaagattccacgtgaaatataggatcaacttttccatttcttcaataaaaggccattgggattttaatagggattgcattgaatctatggagacaattttggaccgtattgctatttcaacaatgttaaatctacctatctatgaacaggaaaactttttccatttatttgggtcttctttaatttctttcatcaatgttttggtgtacaatttagagtgctcttgaaggcgaatatgtatactccataaaactatacagtaattttgttacctttttgtgggcatcaaattgtaaccaagtagcttccccaaaaatatactgtctgtgctcttaaattgtggttatggcattttttatgacaaatacaaatacttgagtgttcttgttaactgtggcatcgttacttttttgtgttttatcattatagtccaacatgaagaaacaacatatattgcaattgctttgaaatcatcaattcacctttatgcatgggcaccaaagtcctttgatgaaagcactgctattaaagtgagtgagctcctttttctttggattatatgattttttattttgagaagaaattgtgaacagaatcgtaccttggaatacagatgcagaagtatataccattcttctatagttaatgaaattttgttgttagtttgcttgcttgtttgtttgtttattttttagatacagggtctcactctctcactctggcccaggctagagtgcagtggcatgatcatagctcactgcaaccttgatctcctgggctcaagccatcctcccacctcagcctcccaagtagctaggactacaggcatacatcacacctggttaattttttaatattttgtagagatggggtctcactaatgtaacttgaatataccatgtcagtaattactgtttaacccttttttagacaattcacaggcatcacagcaagggagaatgcgagggaaatccctggcccctccccttataggacctccccaccagcgcctcactcccaattcctgtagtcaatatgaagaccttctctttcagagcctcaaacacaggctttgggtgccaccccaataaattgaagctgagaaagtccctgttttctcttagtgggggatagagagcagagggaaggtaaagaaaggtatggtaatgatagagggggaacacccttggaggaaaaaggagggaaaagaaagcctttgctccagttaccatggccacaatatgtgggtatgggaaggggttggatgagtctatattctttccaagctggaactctaaacacatttctctctctatctattaatattgtgagacatggtggttaggcttaccagtactctttctaactttattacagtttggctgaacttctatggataggccacataaataaacaattgagtgtcttaaacaactaaccttaaaatgagggactgtttttatctagagtaacttacttataatgctccagaattctacttaaatggaattattttgtatttattccatagtaatgagggttgactaaagaactggcagcattctatcatgtccagtagcttctaacctaggatgtatatcagaattagctggaacatttggtaaaggtttagatctcagacccaacaccaggctgaattagtgggtctggagtagggtctgggaattgatatttttagcagatgttccaggtgatttttaactagttgatccatagacaggttttaacaaagcactgatagggacccatcctgacagacgcagcaaggtattcatgaaatacttttgtatcttaagtcaggatctgtttacatggtatattttgtaagggaacacatcacatgtatacaataaagatgagcaaattcttatgactacctgccaatgtctatttgcataataactatgttcttctataaattatacagatgactgtatatacagtctgagtcaaccctaagacaaatcacgtcacatccctgatctgatctccctaaattgggccttggttcagctgtcagtatttggatatgggtttattcttgggtgtctgctgattggtcagagctgcctggtatggagctggaaagcgaagaaataagtaccaacagtctgtctagcctgatacacagttcttgtccaagtcctcactgcagttcttgactcccacctcacaactacagtatgttgaatcctgtgatgctcagtcctctaccgtgatctgatcttggcaatgaatcctgtttggccttttgttttggactagaaaccataggagcctagagtacatacccagtatatggtaggttaacatgtctggcccttttcattccctaccaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggcaaggaacttgaagacagcaaacagaatgcagggtcatacaaggctcttatgatcattgccaatctgacctttgaagagaaactcaatattttgaagctattgaacataattatttctttgttgtaataacaggtctaagaaaaactgtaatacacaggtctctaaatacaatatgccattttaaaaatccacctgggttttgtacacttataaacctgacaaaagagtgagggaatttttgccttagttagaatgtcatttttggccttttggccatatttggttttatattcacaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatgtaagataacaccttcagattcctagaaattattgtataccaccatttgagtttttccaactgtcaaaactctgaaaggtttaaaaatatgattagtaatgtctataccggaactgagacataaaaggtaagtatagagtgccagaaagtggtcttgcataaacaaaaaacactgatgattccttagtttagaaagctgagtatattctgcagatagattttgcttgtcttgcctaatttttttttatttttaatgaataaagtttacacttaaactctggacttctattgctacatcagaagaccagatagcatcagtgccacattactatctagccattatcaattggaatgtattcattcatagctccttttagatgggatatgtgctctacattctctacccatttatgtttatatatttataataactgaccataaagtgtatttgattttgcagtacttgctttagtttttctgcacttcacaatgcattaacaaatttttaaaaaatacaacaccagtattgcagcattattatgtgtattcctattctttattatattacctcaacagtgacataacagcaaattatcataaaatgttctcttatctggttaattatagttagaatttctgatcaaaagattcagcattttaaaagcagatactcctcaactcttaaatgcttatattttgtgaaatacggtgcaacacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaagaaatacggtgcaacatctaaaatatagattgtcataaaaatattatacacatcatttacataaagagtttgaacataatgtaatatccctcacacacaccatacaaaatataattctactgtgtctcaaatttgatgttggcaatgatgtttgtcctattgaaatttttatttaaaaggaaggcctaaaccaacagttctctgcttcactatatttaaattcccaatttttagacaaccaaagttttagcagtttagcattatacaaaaagtccaggagaaaactttgatgtattttcaaattactacagttgtgtgatattttgaacagctctcagaattgtctcatatgtctctaacaaattacataaaccaattgtcaggacattagtggggacaattttgtaaaactcttttggtcatattaaagataattagcttattactcagttgttgcccatgattatatagaaatcacactgttgataatgtataaaatactgaaccaatcttagccaaagccacttaaacgtgaggtcaagttaattttgatatagctattgttgtactcttcagttggagtgtcttccgtagcttcctgcatctctcttttttttttaaatgttgcgtcagatagcttttattaagaagctagtgcagtattgaactttgcagcattggtccatgtttacacttatttgaaaagtaattcaggaatgttgacccgcgtgtttcacatgattaataagcaaggaaagttatttccttttgaagcaatttgttagttagagatgagttcttaaaaatcactttctgacccaattaggataccttgtgtatattcaaaaatatttttagctaaatactctagtgtcttgacccatttaaagagaaaggactctaatatcagggaggggggtgtcttctgagaaagaatataataaaaatactatttttccaagagtgctagattacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttggcaagtatagtttctgacttttttttttttttaatgtgctagtttgaagaaaccatagaggaacacaatttttcatttgtagggaaatactgttaatgtgacaatatctgtagtttaagaaaactttattgcattgttttatgcatcatgaaatttagaaatgcttagatatttcttagtttttcatattatgtcaccaaatatgtctttgaatgtgtatcttaagtgcatttgaaattatattaattggaaaagaaattctaacttttttgcaaagggggaaatgacttaaagttatatttcaagctgtgaagactattataaagctgtcccttgtaaacattttaagcttaagctattttttagattagttttctatttctaatttgagtgagttggctgataagcaagtattgtatatttgttatttgatttgtacattaattactaaagtatttattaatgtgttatcttaaacccaagtctataacaagtagtgtttcttctattatgatacataataatttgtgaaatgtcaagaaatctctttgtgttggaaatacatctttgcttttttaaaataaggctttctcctaattataaagaagaatatttaacagttatgaatttatgacataaagaaagcagctctcttcaaatattggatagcatgcttattactttggaaatagaggtttctcttcctccttgctctttgaacctcttttggtctttattgctctgccaagctgcttcgattaaagtagtagtgataaaatattggacatataaatctttatgaaacataattccagcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctataggtatgtatacaatttatttcttcttcaggaccccagagaaaatttacaagggtaaaaaagtgtcctaagaaaagatttcctgaattattacattttcttaagacacataagattagtttggggttctgcataattattctcttagtaaggtgatgcctgtatttgtcctatgcttaatgaattcgtgagagtaccacaaagagactcattttggttatctgagttatttgcaatattgtataactgaaatgagagctaattcctttccacaaaaatctataattttgttttaactccctttacttgcagactttacacagatattggaaatgcttcttttcatcacactgattgtggggtttatctttatcttaggagactgccaactagtataaaagagccaaatacttctattttttatagtcagtagagttctattttgtgagtgatattcctgtgaagaatcaaatcatttagaaaagtgacagatatgactgactggagtgcttgttaggtaccaaccacgtggcaacaaagaaaaatgccttttcaccttcatcaaaccaggatatttttttcttcctagccaaagcaggactgctgatctgagaaatccaaataatttgagattcttgtatatgttctgaggctcagtgaccccagacgtgattctagatagggaacataatgcatacaaaaagtaaatatattagagagagtagaatgattagctggaggatagctattatagaaaagagaagtttaatggagaaaataaaggaaaaaggcagcagtgtgtgtgtgtgtgtgtgtgtgtgtgtgtgtgtgtgtgtgtgtgtgtgtggagagagagagagagagacttaacaattgcatcagatattactaagtgttcccatttccaaaacattgtgtcccatctcagaaagcaagctagctcagtagctaggttaagtggcagatgtaggtgttttgggactaaggtggaaattatgcgatgtcatatgaactatgtacttggactcagcaaaaagcctttgctttaggtttagaatttttagtctatgttgttgttgacaacatagagacagagagagagagagagagagagagatggtctgtcaaatgagaaggcagatgcttctgagatctctataaaatgactaaatatgatcctcatgtggctttaaggaccattttgaaagaactgctttttaatgaacattttttatatgggatgatggcactttgcattgcatctgcagaatccttcttctttttttttttttcatatatagtcagtttaaggattgtcctgaaaacctgctccaatttcctcaaacaagtaagaactcacagaggttttaaaaccactttaagtgacagaagataaatgcttacagtataattgacagattcggggcaaaagaaagtaaaaataatgactcatgttctatcctttacagtggtacttttgtgatcgatatgctaatcagaaatggttataaggaaattcagttcaaataggaaactgaacaaacccttatatttatgccagtagacaatcataagggtcaaagggatcttgagaagtcatctggtgcagctcttgtcctcagacaggacaacttctgacctaaaacaaaaaaaagctactttaagttgctagaatttgaaagacagctacacgtaaaataaattacagtactataagaacatgatactttagtttgtatattaaggatattttgagagtatgctaaagactgtcatataacactgatattaaggagatcaattactgtattattctgtctacaaacaactgctttgttatttaaaactaattcagatccagatttccccaatttaaattttatgttttcttaagttataataaatgtgttcaaatcattgctctccatttccaaacaaatatgtacaggcttaacaattgcatcaggtattactaagtgttcccacttccaaatcattgtgtttcatctcagaaagcaagctagctcagtagctaggttaagtggcagatgtaggtgttttgggactacggtggaaattatgcgatgccatatgaactatgtacttggactcagcaaaaagcctgtgctttaagtttagaatttttgatctatgttgttgttgacaaaaatatcatttttaataaagtagtcacataggtgaagaaattcaactctagatagactagatctgttacttgttcccaaccctctggagactgattttccttatttcccttatatctggagttattttaattctagtctgaaatttgacttataaagtcttcttccaggataaccatttttcttagtcaacttattccttttataatagaaaaaatgaaaaatcaaagtaattaattgaattctgattttaatcatgttaatatgagaatgaagatgccttattttgttgtttcctagactattttaatttgagtttaaaatcttgatattattttaaatgtcaggattttatttacttatggaatttttccccatgaagtacataaagaatattaaattgaaagttaaaaatgtaataatagtgctgttccttgtgtcaaaaaataccttgcagcaccagctgactgactgtttacacaattaggtttaaggcaattattgtcataatctatatttgtcacaaagtattataaaatagagtcaaaaaagttaaaatcttaataaatatttcctgagcaggaaaaaaccttaagaatatcaaattagctttggttctgcttacaacatgataatttattgaattgcattagggttgctacagtcattatttgagcaagtcattttttaactattttaatttttgagagtcaggttttcatgtacgtcactggagcacaaatatacacccttattaggagcccttattaggaatgctgtatgtcacttagactataaaatgaagagtggctgtgagtagatcacaatgtctacaaatgggatagaattagttcttagctttttctatggtcttagaggatatgaatacaagaattaaataactgagacctggtaattaaatgttgattacaatggtgcctttagatagccagtttgaacaccactcttgagcagcaaaatggccaaacaactgactacaggagggaaaaacaggatgtgctaacctgaactgtaacaatgagcctcttaataaacaaacattgactgtagttataattttctatgatggccagaaagattttgtgtttttctgattttttttcatttgtattgtagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaaggtatagcttacaccctccagttacagcaaaaataacgcaaccattgaaaatgaaccaacaaaagaaatttctgtccttttccttctggctataaatatatttgtggtatattttttcaaactggcatactattgattaaaaaacaattttatattttgcagtagaaacgctaatttggtaagtgatgaaatttggtttcaaaagaagctcattttgaaaaaaataagaaaaaattctagttatgtcttaagcaaagcttagccattattttatttggttcgaaatcctttattgtctttgattcatagtacctttcatgttcatattaaaatgatatttttaaacaaaatgcttgagcaaatctgccttttatagctttcaacataattcaataacagaaggaaaatgtacttatgtttactgagcacttaattgtatagtaggccttgtgctagatactttaacagctatctcaattgatcttcacaagtgggtgttatgatgtttattttgcagaaaataaaaataaaatcaagatctggcaattatttgtataatttgatcaattttaacaactaattcaaatagtttagatggaaaatttcatggtgtaagattattaccattcctacctattataggaaataatagtgtgaagaaatagtcctaataggattaggaaacattcatgttgagaagagattgcagagggtttgagttaatatcagaacagccagggtaaagcactgtatgtcaagcaaagttgccaacttacaatgtgaagagatgaaatggcaaaaacctgtgtttcaggtcagcgagacctagaatgcagtcctggctctaaccaggactaaccaggttagagaacctgagaagtttgattaatctttctgatccttagttccttcatctccaaaatagaaatattaataactgctttgggaacaattgtgacaactagtcatatctgtaagcatctcacagattgcctgtaacatcagatatgttaagtcaagaatgactagcatatcttttaaaaaaattacaatgttgtctctttattatgaggtaaaatacttactatgaaatgtaaaatgctgttttcatatacacttaaagccctgcatccccctctgtatagagcaaactctgtaaaggtttatgaagatttttatttaattgggtataaagcagatcttagaagagttaagcgagggcattttaaattttatttaactcagtataatcatataattttttcttaaaagattatttgttttcttgatgactactaaccgaagtaactatgattgctgcctttgtctaataatattaaatatttttaatatttaaattttaataatttcaaatattatcttttatcaagcaaaatgtacagttacatacactgtaagctcacagtatcacaaattagagactccctgcttccctttgtcacacctagtgtatcttatcatcatcattatgtcacaaaatctcctaaatatagccactgtggatgtcaaaagccttagtcctaacaaggagacatttgtttgatatttatgtgcatattttgttataattttctttatggtacagaccacatttacacaacatgtccctctctaagccactgggtttaactcattttatcaatctattgatgtccattttgctgagatagaaaattgcatgagtggatgttaagtgctctcaccataaaaatgataaccacatgaggtgatacatttgttaattaacaagatttaacaattccacagtgtatatggacttcaaaacatcattttgtttgtgataaaaacatacagtattatctgtctgttaaattttttaatattaaaaaataatgaaaagaaaaaaaaagaaaattgtaccaagtagaaaatttcaatggcttcttaaatataagcagcaatggtaaacaacacctaaataatttgtttccttatattaaaagaaaagccaactggaatataagtagattattgttttaaaaagcaaagaattattgcccaaaaataatcaagaacttcagcaaatgaaggccacctacgaaattactaattttatttaaccatataaattataattatgtagactatagtaaaagggttgttttaaaaatgtataaattagacttcaaactaaagtaaactcattctttcatttgaaaaacaaactattccacaaaacagtaaggcttaatatcttaattagcagatgcagataaaattatagttatatgaaatatctggttgcaatgtattaaatatctgttgacagtgtatttctttctttttcaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaaca

SEQ ID NO: 898 - DNA, 14037 bp, mus musculus
cacattggaatgctgctaaatgaaatttcatgattaaagataattgagaataagtttttacatggcaaaccagaaatgaacatgtacccagtggaataaaaaggtagttgggtaaggttctagcagatagcactgcagtttccacattaccacatgagactattagtgcacacacacacacacacacacacacacacacacacacatgctgagatttgcggggagttcatttgttaatttgagaaagatcctaagagtctcattaatgcccagggcccagggcctgttctcattcagaagctacttgtgggggaaacagccctgctaatgatctcagttgtcttgagtgagcacatcagagacctctgaaaagccagctctctgcagggctacagctgggtacttacatgtactcacccaagacacttctaggctggaagcacatgattaatgagagtaatgccagcttccagaatagatgtctctgtgaagccagccctgagcctcaagaatctgaaatggcttcattgggtgagggtcacaaatctctgctacatgaacaaggctgtctgtctgtgtcacatgccatatgtccagccctgagaacaggtgtacaagagcaaagttgacatggatgtgacaacaaaatgcccagtcccaggccacatagaggaaatgtgactttgagctggagaatgtatactggttggctcagctcaggagggcactgagggtggaagattacttttctttagtcaatcagatgcccctggaaggaggattccctgtaatcgcaagagccatgtccatgctgattgcaaggtggggctctttcagaggttgaagtaatgcattttttgaaggctcccacttgcctgcttcctcccctctccacttctcagaaagccttccccataccctgatatcctgcctggtaacatggacagtctttgtgcctcactctctgaaaaaaagctggggcgggaaggatgagtcttcctcgctgctatgtttctggctgactcgctatgggaagagaagaggggtatgaagagtgcatatacttatgactggacatgactgtatgtgtgcaggagaaaggaattcctaggaaagttaggggctggggtgttctctgctgtttgttctctgagaagcaatgtggcatttactgataaccagttacttctctgtttcaggaaaaagtgtgcaaataaggctgtggttcaacaggttttggacaggatgctgatgggacacaatgcccatctgagaccaaattttggaagtaggccacttccagacacttgagacctttgtgttaggtcaaatagagctgagacacagcaaaccaacccaactggtaagcctaccagtggccctccgcaggctctacacctctgcctctctagatcccaccttcctgaccctgaagagacatgcagctgaacactcccgggcctccaatctccaggcctttagctctatccctgcaatttctgccacttctttgcttgtatatacaagagatcttctgctctttccacagtcccttgtgagggcaccaagcctaaatatgcaccccctgttgtggctgaagaggcaatgggtatgcaggcttcagggtgctgtgcttctcaagctggagctttctgctccatctattacactctatgggtaaggcacttgagcacacattctttgcaccctgggcactctccctgttcattttattcaaaactgtgtgcatattcttcaccatgcagtctacttcacaaatctctgttcagtctactttgactaaccaggcctcagggtcttcccccattgtccccaagccttcagttcccactgatttttattggctctacctctggaaaacatcctaactctgttcttatccctccattgatcataaggcccctagcttaggcctcggtcatcttgctcctgaattactgcaccttgcaagttgctttccctttgcttcattgctcttcccagagtgtgagggcataagatgcagcccacagtgtatgagatgattgtgcacctagggactgggatgctagggtgtagagggcataaggcaggctctttcaataaccttaccctataaggatagcaaagcctcttcttggtgggccccctaagggagaggccaagacttttaaggggagagaagtctaggtatattggaattcaggtgttaggtcacagccagatccccgctgcattacaccagggcttgtgtcaattgagccaaatactggtgggtgtcaaagaagtagctacttcatgtactcctttctttgttcccatgtttttcagcaaaggctaaccaacaaccaattaagtacaccaagcacattctccctactcttttatggtcaggttgtcatctcagcatgcatccaagaccagggaaagggaggaggggcaaggaccaacctctggagatggtcaggtgtggatagtcccaaggttcctcaccaccatttttcacacagactctgatttgtttatgcttgttgtctcaggtggaagaggaaggggttgcattaagctttcttagcatgcagacttggggcaaatgagaaaaggtgagttcctgcattgatctggcctagcagtagataaaggtaggagggcaagacaactgaggaccttttttagacataagggggcactacaggctctatgtttggggtgtgtgtgtgtgtgtgtgtgtgtgtgtgtgtgtgtgtgtgtgtagggaggccaatagatgaaacagctgcactctgaatgggtgggtggaaggggtggagggagtagagaacaaagcaaaacacccagaacactgtgtttgtccttggagatagcctcgccacctggtcagcaattgcagcatgctccagaggggaagcccagccaggggagcaggagaaaaggctgggggtgtttagctggcaggaaagggggcctgggtagagatttacaacttgattctggaagagagcaagactctaggaatcaagaaattaataggctaaattacatattggattgcatttaattgatggaggcaagatgccagcgggagaatgagagctgacactggacagaaatacacagagaagccatgacggaaaagaaaagggatgagagtaaagaataaggaagataggaaggaaaatactgcttagataggtagtacttggtacatcaacaatacttaaaattcatttgaaccattgcctgcttcccaggcaggttgagtcagcccatctccaggtctgtcaggtcagcagtgacaatcaggatccaggcagtgacacctattccattaaagagtcaaaagcccccatcccaatcccttttttcatgcagggcttcagggaaaccaagccaaggacttcagggtttagggacccccggaattacctgtgaggcctcccacaagaataagagtcagatttctctctgtttctgaggtgaaatagagtttcaaggcttaacctgttccttccactccttttcaaattcacaaacagaggccttagtgactgtaccctggtcaggttcatacaggagctttattacttccttgagaagtagggtagggtggtgaggtgaggaggaggaggaagagggagggaaagctagcaaagcttcttctctgtgggcaagagaactgggttgccacagtgctgtgaaaaacagttccctgggggcttcacttagcacagtacctggcatgacataagcatcccaatattgtagggtgaaggaaagaatgaaacattttcctccattccttcattcacctgttttttgatcactgacactgtgatggatgctggggagggaagtagttaaccccaccacttttcttgcctttctgaactcatcaggaagcacagtgatacagggctaaggccatcactccaaagatggcatttaggcatcttatctggaggcttcttttttgattatgcttttagagatataggtataccttagctaagttctcatcctgatcacagctagcacgtaaagtggctcatctgggcagataaagtagaagtattctttcctctggtctgcatctctgtgccagagcacagggcttagtgaaggtaatgtggcctgtgtttctgctcccacttgctctttctgctgggaaccttcagatagggctctgtgctggccctttagggtaccaggattccactgaaagggaggagttgcttgagtggcactgaatggtctaggataagaagtctgatcctgggattggaggaggggagggggctgcctggcctcgctgggatttattaactgtataacacagcctctatcctctaaaggcatgtggggagcctgaaaggctataatcaagaactgtgtttctagaaacctgtcactgcatagcgctttgctaggggttgttcacaatagccctgaatgctggagtctgggctgcgccctaacacaggcacccatttacttgtcagttgtcattcagacacttattcccaatagcacttagctttttgaagcattggggttggagtacacatttctctctttgcagctcagcttctgggcagtaagcctgcaaagaagccagcaggctgaatgatgagggtcacacatattttcatagcaggagtgtgatgtaatacacagagaacaatggccttgctgtagagctggttataggcagctttgaacccatagggaataataaaaatttatttgtgcacaccaccttaacagtttacgatacactttaaaatccatggtcatatgtacattttgccagtggacagtgatagcacagaggcccaaagaaaaacctcaagatgaagaaacatactcagatacatgctcacacattcagtcacatttgcacactaaaacaattacactcccatgtgtgttcacataactcatacatgaatacagtcttagattcacatatatgcctgaacatacacacaataacatgctcacacacacattttcacttgcaagtgaacacattcaaacatatgaacttacacacatattgagacactcacatatgcttacgtgctcacatcttcgctcacacatgtatatactcacatattcacttaattaacttattaatattttaacatgctcacacaaaaaattatcatgaatcaactcacaaaaaggaaaatattcccataattgcacaactgacattcattcacacacacagacgttctcaggcactcatgaccacaataagatataatgtgctcacaaattaactgacaaacctatacacacaccctatacacactcacagacgtacacatacttacatcacctcaagctgtacatgatcacactcccacacatgaacttccttatgcctttacatacccatgaacatgctcacacacacatcatttactcagacatgaatgaatttcacatattcactcacacaaatgagcttacaaatgtattcacacagacacattcactcacacacattacatgctcaaaacatcaactgcaaacacttttatctgcacatgcttatgctcacacaaatgaacatacttatacattgactcacacatgaacttactcaagcattaatataacaagacacatgaacatgcttatgcattctctcactcaagcacacattcctactttgactaatattcatgcataaacacacttacacaaagacatactcgtgtttactcactcatgtacatgcttgcatgctcacatacacactcttacatgcatcattcactcacactcagatatgaaaacacttagatatggacatgctgccacgttcactcaaaaacaagaatgtacacttacacaatcactcatgcatgaacaagtttacacttggaaaaaatttcacatattcacaagactacatgctcatagacgtgtacacacattaaaagtttcacacacaccagtgcacaatagcttagaaacatgaatatgatcacatattcacacacagataggatcatattcattcatacagtcacacacatggacaaactcacgtctacttatgtcctcacacattcactcatacttgcacatgaacacagacatacatcatcactcttacacaaacatgttcatacagttattaacaccctcacacacacatgctcccacatccactcacacttatattttaacatgcacatgcatagacatgctcatgcatttatccagacataaacatctttgcacattcactcatacacgaatatactcatttacatgcacacatgtaatactcacactcacatatgaacacacacaaatatggttacacattcattcagacacataaacatgttcacacacaaatgtatgtactcacacaatcacttgcacacagacatgaaaacattcacatattcacacaatgaacctgctcacaaacttacacatataaccattaacacactcacacactcacaatcaacattcacacacagacacatgcacacaatcattttgacacttatgcgaatgaacatgcttatacattcactcacaaatgaagatgctaacatgtatgcacatgctcacaaattgacacacatgaacgcacacattcacttaagcacacaagtaaactctaacactttcacacatgtacaggttcaattcattctcacacagacatattcacatacatgcacatagttacaattcactcatataaacatgctcacagatttattcttactcatagacacactcacatatacttgcacaaacacacaaatatactcaacatactatgtattcactcatgcactcaaatatgcctcatatacacaatgttactcacactttaactcatttgcatgtacacactcaacctgaagatgctcatacacttatgcaatccatcacacacaaaaaacatggccacacattcacacgtagaatgtgagtgaatttgtaagtgtgtgcaaatgactatatgtgattatatatattcacacatatagtcatttgcctaaatgcttacatacacacacatatagacaaattcacctacatgcttacatacacaaacatggtaactactcactcacatgcatattcactaacatcaacatactcaaaaatttactgacacacaaaaaatggttaaatatatgcacactcaaaaattcattgacatcaaaaaattcactgacacaaatgaatatgctcaaaaatttattcaaacacaacacacagacccacacccacatgctttcacatttactcatgaaacatgcttacacatttactcacatatatgagtatgatcataaactgactcacacagaggcacattcatatgattacattcatgctcatacatccactcgcacaaaaatgctcacatattcactcacatgcatacgcttacaaattcacttacactcatgtatgatcataagtacacactcacaattcacttatgtatgcacattaacatgtacccaaatggtaacatgctcacacattcacttgaacacagatttgctcacactcatcacaaagttcacatatacagtcacacacacactcacataaattcacacatactttctcaaatacaaaaatgcagtcatacactaacaagctcacacaaatgaacatgcttacacattcacttacacacaaacatgctgacatccattcacacgattataaatttatccacaaatatggacacatgagcatttacttcatcatacaaatacactcgcattaacatagtctcacacatgaactggctcagatggacatgagcatttacttaatcatacaaatatactcacattaatatagtctcacacatgaactggctcagatattcactcacacaaagatgagacagacatttacacacccatacatttactcaaacatgctcacaaatttacttacactttttttttttttgagacggagtctcgttctgtcacccaggctagagtgcaatggtgtgatctcggcccaatacagtctccgtctcctgggttcaagtgattctcctgcctcagcctcccgagtagctgggattacaggcgcctgccaccacacccggctaattttgtatttttagtagagacagggtttcgccatgttggccaggctgctctcaaacgcctgaccctgtgatctgccagccttggcttcccaaagtgctgggattacaggagtgagccaccgtgcccagccatttactcatacttatagacacactcacatatactcacgtacacagtgacattcaccaaaacacaggtatactcatatttacatactcatatatataacaatattaattcactcacatacccaaatattttcacatacataaaatcatttacacatttactcacacacatcagcacactcacatgatcactcaaacatgttagtatacttgactttatcgtgctcacacattcacacacatacataaacatgcttacaagtatacttacatacatcaacctccttacataaatcatttgcataactcacaatccagtaacactcatacattaacatgctcatatattacacatgtactcaaaattcactgataaatacttgcttactcacatgaagatgttcagattccctcaaacataaaatatgctcacatacatgcacatgctcacacattcactgaatcacacaacacacatgttcatatactcacacaaacatattcacagatttactcacacgcatagacatattgacattcacttgcagccatacacttacacattcactcacccatgcaaacacacttacgtatgcgttcactaaaatttgctcacttattcactcacattaacctgctcataaactcacacatactcatatgtgcttacatgcaaatactcacatatttacttatccatacacattaacacactcacaaacaacatatattacctattctcagcatactcacatattctcacaaatgaatatgttcttaccatgaaactcacacattcactcacacacacattcattcattcacatgtacttacatgcccatgcttacacattcacttacactgatatattcatattcagcaagctcacacaagcatatttacacattcattcacacagatgaatatgctaaaatccatgtccatgattatgaattgactcacaacacacacactcacactcttgcacatatgctacacattctctcaaatgtactcatacattaaaaatatcacacaaataaaacatttacaaattcactgacacgtacatgctaatatccacatttggtcacacattcactcatacatgggaacatgcacaaacacttaattgcacaactgtactcaaattaacacactcatacttgaacaaactcatatgttcactctccaacatgggcactgttacataaattagccaaagaaggcctctatattactggccctttgttgtttacctcttcaaagcaggctaggatccattagcttgaaagccggctggcacaaaactcaaattttacacattctgttattttaaaaatagcccaaataagcagaattgtagccattggagatcctgcctgttttgcatactccacaaaacagcacccagcatctgctatccatagctaagataaagcctatagctataagagaccccccaagtcaccgctgttctttggcactctctgacccagagactctgtcatcatgctgctgagtgacatcacctagacacacaggtcccctctctgattccactctttcctggaaattatcttgccctcttccatacccttttctgggtggtgcctctggaaggtctcctgttgtgagggttgtctctctcacgcaaacctgtgaaagtgtcatccaaataaagctcgctgtgtgctaatgccacatttgggtcatatctttttccctgatcagcccctaaattgctcgaactcactacaagtggttatgagggaaaggaagaattttggtgatgatcaggaaatcaatacagggtccacctagttagtagtaaaatcaattgacaaaattatttcagacagtctttaagtagttcagactcaaaatttggaaggcctccagtttggcatggctttactctgtgctatattatactctatatttgttgtgccccctccctcaggacttattagcctaaccaagcaccagcacccgcatttgagcaaacccatgacattgcaatggaggttgggggtcaaaggcactgagctccctgaggaaggaggtctgcctgcccacttgggtccctcactgggcaggtgctggagattttaagacctgtgggcctgaatagaaaaaggggaggagtgcatacctgtagaccaaaggtaggttacccttgatttggggtactctgagacgagaggacatctttgtccctggggactgttatgacagagatgtcaggcctaggctgctctcttaagcacaactgggggagacaccttcataaacagcaagcatgactctactgctgtttgatttgtacctgttattgcagaaggctttattctagttcctcttccgcaggaaatcgagacctaaatccttggactgagctggctaaagcattacttgtagtgactaaatacaaggatgtttatatgcctgcccctcccagaactctgagggaagtggctatcctactgaacaggaagaatgctaggccttactcatggcagcttctgactaggacactgctggaaaggaggtaggtgcccaaactcctgagggagacaagacagacgggaggatcctggagaagacgatttatgtcctctagaagaaaaagcagcacagtaccacgatgatactgataaggacaatttgccttctgctttctaggtaagcactcacagagtggtaaagttggagaagacaaaaagggagggtcaaggaagtgaggccgttttttggttagaggaggaaacacatcctctctcttgtcctgagatccagtctctccttaaggacctagcccaagaaccaaatgaaaaaaagggttgcatggctatatagaacatatatgctgggagcgaactccacctcatgggagctgaaattaaacaactgattaccatcatatggtacggaaaatgatgtctctactaaaagatcctacacaattagtggggaaggtaggaataatcccagaggaggcattggactcaagtctacatataccttgttgatgtggacctttatggctcgagaggattcccaccctacattaggcctcctaacagccctgggcagactgtcaatggaaaacattcacctcctattagctggggatgttgaaatgggcttatcaggcaacagaaggcatgcagcatagtgacttggcaagtctggaggaggctgaattgaatcttgaatccacccaattgtttctcaggggggctcctgacaagtataagtccacattacttgatcatggtggataagctttttgatgatgcaaggctggttcaacatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaaaacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctacaaaaccccgttgtctcagcccaaaatctccttaagctgataagcaacttcagcaaagtctcaggatacaaaatcaacgtaaaaaaatcacaagcattcttatacaccaacaacagacaaacagagagccaaatcatgagtgaactcccgtttacaattgcttcaaagagaataaaatacctaggaatccaacttacaagggatgtgaaggacctcttcaaggagaactacaaaccactgctcaaggaaataaaagaggatacaaacaaatggaagaacattccatgctcatggctaggaagaatcaatatcgtgaaaatggccatactgcccaaggtaatttacagattcaatgccatccccatcaagctaccaatgcctttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacacagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgtttgacctaaaaccataaaaatcctagaagaaaacctaggcattaccattcaggacataggaatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggcgaaggacatgaacagacacttctcaaaagaagacatttatgcagccaaaaaacacatgaaaaaatgcccatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgaacatgtatgtttattgcttcattattcacaatagcaaagacttggaaccaacccagatgtccaacaatgatagattggattaagaaaatgtggcacatatacaccatggaatactatgcagccataaaaatgatgagttcatgtcctttgtaaggacatggatgaaattggaaatcatcattctcagtaaactatcgcaagaacaaaaaaccaaacaccgcatattcttactcataggtgggaattgaagaatgagatcacatggacacaggaaggggaacatcacactctggggactgttgtggggtggggggagtggggagggatagcattgggagatatacctaatgctagatgacaagttagtgggtgcagcgtaccagcatggcccatgtatacatatgtaactaacctgcacaatgtgcacatgtaccctaaaacttaaagtataataataaaagaaaaaaaacttaaaaaaaaaaataagtccgcattactggcaatgatggctaatgctaaaacaattcaagaggacacagctgccctggatttaatagaaatgcatgaaagacaaacagatcaagtgttgcctattaattctacaaa

SEQ ID NO: 899 - DNA, 14037 bp, mus musculus; identical to SEQ ID NO: 898

SEQ ID NO: 900 - DNA, 72801 bp, mus musculus
tgggagggaattggcaatctctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctctgaatgagaaagagcaactttgtaggaggttttgagtaatgaaggatgatcagtgttaccctcacctttttttttttttttttttggaatagtggaaagattattgactgcatacctaagtagaaaactaatatttggtttcaagtagatttaattctaatgaaagaaaaaacaagactgaaaagtcatgacattgaccgtcctttatttctcaaaatctcctacaaggctgccctttcttattcaaagagatctttaaaggtaattttttacttgatttcagagaacgaaatgttccagggagggagaggaaaacagtgtgatttgccctccctaggtattgccctatgggattttaaaaaaataaaaaataaataaaccaggctgggcacagtggctcacgcctgtaatcccagtactttgggaggccaaggcgggcggatcatttgaggtcaggagtttgagactaccctggccaacacgttgaaaccccatctctactaaaaatacaaaaattagccggacttggtggcgggtgcctgtagtcccagctactgatgaggctaaggcaggagaatcacttgaacccaggaagtggaggctgcagtgaaccgagatcgcactgttgtactccagcctaggtgacacagggagactccatctcaaataataataataacaataataataataataaataaaccaactacaagccaacatccacaaatatatgaatataacaccaagttcagtgattccacttgccccattaaccctgtttcttttatcttccttgattttttgatagttttatgtctctattcagctataattattttataaaggcttagtttcctcatctgtaaaatggggataaaaacttgtctttcctacctcacagcattttttatgtgggtcaaatgagttttgaaacttgtgagcaactatacaaatacttgacatttatctattaatgaaagagaaagacgttaaaatgccattttctgggcctgaagaacaaaggggttatatatttatgccattttccctagtaattactttccccatgttgtatatagaaattgatttggagtggtaacatagattatatctgatatgcaatgatatcactacaaaaacaaaacactgatagttactaattgaagaatttgggcatgatagtgattatgcatttatggtttataatcagaataatgtacaagaattagaataacttatcatgacatcatttccttttgatctgtcatcgcccaaaacctggaagttctcaaacagtgcttccgtagatatcagcatcacttgtcttgctgagtggtgataaagagtacatataacattggttaccttagtagtatttttcaaaacaatacttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtgatggctcagacagttgataaataagtaagcaaaccaatacaattgctagtgtagtcaataataatagcagccttgttctgttggcttagaaatctccataatgcagggaaaccctcaaagcaattttccaaggccagctgtcttataaagtatgcttatctgaagtcctgttaaagatacaaatatttcctaaaagcagtgattaataataggtggtgtactggtggcaaagttccagtgtggcatctgtgaagcatcttgccaaaaaccagtttggggtgttttcaaattaaatcatccatctatgagcactaacaatatctgagaggtggtttggtagaagtggtgggaggaggggggacgttctaagtaggaggaataatgtgatagtgcaaaagcaaaagataacagttgttggggacacagcaaatattctagattcatttacgtggagttgaaaatatgagactcaatatataatgcacttagcgactagaaaaaggttattaaagagcaatgtcttaatctataccagaggaaaacctgagatagagaattaaagggacctaataattaaacctttgttttttgtgtccactgttctttcagtggacataaaacagcctatgtataacaaaaatttccacaagatattccatcctgctctgagccagaacaattaagtaagataaaattaggcaaatagtcagtaatctatcagatatccactagaagtgtttcaactcataagccaaataaattaacattttggcttattaaaaggaaaatcacgtagagcaacccctagagagggcagatcacactgtgtgctcccctccctccctggaacatcttggtccctgtgaaatcaagtaaaaaattacctttaaacatctctgaatgagaaagggcaaccttgtaggaggttttgaaaaatgaaggatgattagtgttacccccccacttttttggtagcagtggaaagattattaactgcatacctaagtagaaaactaatatttcctgtcaagtagatttcattctaatggaaaaagaagaaagaaaaaaagaaaaagaaaaaacaagactgaaaagtcatgacattggccatactttatttctcaaaatctcctataaggctgccctttcttatgcaaagagatctttaaaggtaattttttacttgatttcagagaataaaatgttccagggagggagaggaatacacattgtgatatgcccctttttccccctcccttactacactataaagaactgaagttttaaaacaaggtatagggctgggcacggtgacccatgcctgtaatctcagcactttgggaggccaaggcaggagaattgcttgagcccgggagttggagaccagcctcggccacacagtaagaccttgtgtctacaaaaaataaacaaaattagcaggacgtggtggtatgcgcctgtagtcccagctacacggaaggctggggtgggtgggagatcgtttgagccagggatgtggaggctccagtgagctgagattgcatcactacactccaggcagggtgacagagtgagaccttgtctcaaaataaataaataaaacaaggtgtaatcacattttctgattattattataatattagttgctctcttgttttaaactaaccaaaatgatgggcctggtttagttcttctaaataatgtttaaaagtactacactgtataccagtttattcatttgctatcatatttgctttcttctttgtacctagaaattcaggtgttgcaatttatttgcttttctgagggttactctttttgtgcattggtgtataggtcttgaagagtaagaagtggctgtaaatatagtaccaattctcatattttcctgtgtctctatctttagaaatgtttctgggtttgattaataattcatctattctttttttcccagaagacattgtaatctgttgtttgttatatcaattgcttccctaaaaaattctaaatcctttaatgaaaaaaagatttcagttagggaaggaaatgagtgcttatatatatatattcagttttcaagtaagtccctttaaaagaatgcagggagagagaaaacaggaccaaagaagaattatttttattaactgttttccgaagctcttaatataaagttggcagctttcaaaatgccaactgtggctattgaattattccaaaataagcattcatagtgtcattttaaggacttacatctggtagcaaagtaatagaatcaggaaaatccacaaactttattgagcacactaccttctcttatttgaatatatttcctgctaagtgtattggcagtttactaattagtttgtttattaacatataatgaaactaagttcagtaaagttgtacttgtttgactttgtaagcatgacaacttatgacaagataaagaatccactgtaagtttccagtaatcattaccgtggaaaaaattataattgaacattttacttagaatggaaataaatcttgtttgtaattaggaagttcattacatggctcttctgcagctagagcagtattcacttacacagtgccctcaatccagtttacaaacagaaagagcaacttgtcaaactaaaggacattttagtttgtgtactaaactagcacattgataatgagtatcattttcaagctgtggctgttttactggtctttcctctagcactcagcccattgccctacctgttcatcattaccattgacctaatacaaaaaaagaaatgtttatgaaatttgcaggtgtctaaatattggaaggggcaattaataccatagatcaatgtgctcaatattggccacaggttagattcaaatgaggaccttttatttttatttatttattcatttatttatttatttttgagatgagtctcactctgttgcccaggtgggggtgcagcggcgcaatctcagctcactccaagtgatgcaacctccgcctcccgagttcaagagactctcctacctcagccttctgagtagctgggattacaggcacctgccaccatgcccagctaatttttgtatttttaatagagacagggcttcaccatattggtcaggctggtctgaaactcctgacctcaggtgattcacccgcctcggcctcccaaagtgctgggattaaaggcgtgagtcaccaagcccagcctctgaggaccttttaaaataaactaaaagatactggatattcatggatgaaatgatacaatgtctagaatttactttaaaatactccaggagggagtatttagaacccagaaattggtacatattaatttctgaatgacttgcagggacttgatgatgattacagcttaatgagctggaagagttccccaagtgactagaaatgtagtctagcactagtttccaaattatttcttgcatagttttatactaactgcctgatttcacacttaacaaaactgagcaattttctttctacatagtacaaggcgcttataatcttgtgaacatttctgctgccaaaaagtgacctttcttgccagtgattttgactactcctctcacatccacatagccaccattaatctttcaacagtatcttcaaaaagatagttatcttttatctttatctgttatctgctaaagctatcctgtattcaataaagtgccttcatttgaaattctaattcctttattttgacaaatttgacaacttatgtttatttatatacacacacatttatgtacttaattctgtttttcaacatagtgatagctcttttggttgtcttttgcgactactcttttatccctttttttagtattttcacattcctatcttcaaattgaaaacattctcctcttctctatttcctcagtaatttttttttattattacactttaagttttagggtacatgtgcacaatgtgcaggttagttacatatgtatacatgtgccatgctggtctgctgcacccattaacgcgtcatttagcattaggtatatctcttaatgctatccctcccccctcccgccaccccacaacaggccccagagtgtgatgttccccttcgtatgttcatgtgttctcattgttcaattcccatctatgagtctgaacatgcggtgtttggttttttgtccttgcaatagtttactgagaatgatgatttccaattttatccatgtccctacaaaggacatgaactcatcattttttatggctgtatagtattccatggtgtatatgtgccacattttcttaatccagtctatcattgatggacatttggcttggttccaagtctttgctattgtgaatagtgccgcaataaacatacgtgtgcatgtgtctttatagcagcatgatttatagtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcgccattctaactggtgtgagatggcatctcatagtggttttgatttgcatttctctgatggccagtgatgatgagcattttttcatgtgttttttggctgcataaatgtcttcttttgagaagtgtctgttcatatcctttgcccactttttgatggggttgtttgtttttttcttctaaatttgtttgagttcattgtaaattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcccattcctatgtcctgaatggtaatgccaaggttttcttctagggtttttatggttttaggtctaatgtttaagtctttaatccaccttgaattaatttttgtataaggtgtaaggaagggatccagtttcagctttttacatatggctagccagttttcccagcaccatttattagatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccgtgtagtatagtttgaagtcaggtagtgtgatgcctccagcttttttcttttgccttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgatcttccatttgtttgtatcctcttttatttcattgagcagtggtttgtagttctccttgaagaggtccttcacatcccctgtaagttggattcctaactgttagaaccaaagacaaaaaccacatgattatctcaatagatgcagaaaaggcctttgacaaaattcaacaacgcttcatgctaaaacctctcaataaattaggtattgatgggtcgtatcttaaaataataagagctatctatgacaaacccacagccaatatcatactgaatgggcaaaaactggaagcattccctttgaaaactggcacaagacagggatgccctctctcaccagtcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctaagcccaaaatctccttaagctgataagcaactttagcagagtctcaggatacaaaatcaatgtacaaaaatcacaagcattcttatacaccaataacaaacagagagccaaatcatgagtgaactcccattcacaattgcttcaaagagaataaaatgctcagtaattttaatcacatagttctgaagacactatctgcatattttggctcctacttttctttctttttactttaccaaatctccaatttctcatagtcactatttcaatgctaaaagtgatagaattatttttccttttatccccaaacccatcagtaattccctcctcattagttgaaatataattattttctgtttccctcatcctcattcccattgtcttttccccaatactttctctttcataatatttgtcagttttctcatttctattttttaaaagcttcaattcatacttgaactttttttcatatcagataacttcttatctctataatctgcacatactgccattgccaaaatcttctttcttgaactttgccctatcaaaatcctcagaaaatttctaattgatgctatgctgcatttgtgactcctgtttttactttttatcaattcctgtatctactctcctatcctttcctttcagctaagccaaatttctctttatgtctttgtcttatctcctactcttctagtttacctccttctatgcatgtaacttcctaatgtgataggaagtgatgtgaggcaaatgtgagcatctgccaatctatctatattctcattcaaaccttgcttaaaatctcaattctttttaagtgggtcaaaataggaagagagccaaaagcctggtttataattgaattaaatttttcttaaaaatctgtattctaaattaaagggaaatgcctcataaagcaaaaccaacactcaaccaatcagagcttccagaaaaggaaggtaaatttatatatttcagccatcccattgatatggttaaatcaacaaactatatccttattgtgcagcaatatgttgaaagttatggatataaacacagagacagaagacatggttattgtcctcagaggacaaataatctagataaagagacaaaaattatatacatgaagctcttagaaagtagttataataaccagcctaatatatgctaggttgtgtagtacaggttaaacatcactaatctaaaaatgaaaaatctgaaatgttccaaaatccgaaacattgattgctgacatgatgccgcaaatggaaaatttccacacctgacctcatgtgacaggttgcagtcaaaactcatgcataaaattatttaaaatattgtataaaattatcttcgggctatatgtataaggtatatatgaaacaaataagtttcatgttcagacctgggtcccatccccaagatatctcagtatgtgtatgcacttaatccaaaacctgaaaaaatctgaaatctgaaacacttctggtcacaagcatttcatataagggatactcaacctgtatagactctaagtcctatgaatattcagagaaaatggaaagtattattgcttgggatagccagtgaggatttcataggggaagtgggtcttgaagaaaatgtagaattcagattagttggactggactagaagactttcattaggatttctttttttttcattagcatttctaggtaaaatgataattgcttagcaaagaccctatgggagaaattaactggttgtttaagaaaacagtgaactttgttctaggaaatagtaggaaatataattagattattaaactggaactaattgatcaagaaccttgaattcctaattgaggaattaagaattgttgaaaagaaaatccctgtacagaagcattttatttaatcaaggttttatcttgtttaaatatctaagattttcttaaataataatagtattaactaatatcgggtgttttactgtgtgctaagcattgctctaagtgcgttaaatgtaacaactcatttaatctttacaacagccctttgtagtaggatctgttttaaccttattttacaaatgaggatgcagaaagggtaagtactttaacttgctcaagttgacacaagcgacagagccagaatttaaacccagttagtctatagtactatattctacattcttatctaatatacatacaaccttatgaacgagatacataagtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggtgagtatgatttttaaaacataattcaaattaaataagggtactacaaagctgagtattcatatttatttatagtctgtagttgctttgagatttaaaaacaaattaaatgtgcaactttactttgagagaatagcaagacctctatttttaaaggatatgggttattaagttttttttttttttttaatccattggtgtgagggacctgaagcatgtggtctagcagggctgattctgcacagattttggtcagtgttactgctatataactcctttcttcaacttctgctttatccaactgctgggaagatgagaacttctccatgaaataaattgtttcattactaataactcaaatgagaagaatctgaagttatctgtgaacccaaaacataatgactcctaaggaagtataagcctggaaaattaaaccttttttattcattcccaccttctcagaaaaagcatcatatccttgaaatatgaaggaatgtcttacagttaatgttacatattcattcatgccagggtggttcagatgcttcaacatatatattatgggtagaaaaggaattaggataatcctttctaataaagcaagtcaaaataaatttttaaaaagctgcattgacagtttcttacttccttttatgatgccattataatgttggtctaaattagaatcccagatttctagcctttttgatattgaaaaactgcctttcttcttatccccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggatatatcttgtagatggagtgccaaaacctttgactctcatgtatgaggatcaaagtttgcatggaaggtcattgtttcactggcacctttcaggattggtagaaacgaacatatgaatttcagaatcagtgtgctaaagaaaactgtaaagtctttagcacagggggagattgatagatattgaaatattctcttaaaacatactggttattctttaggtaccaattactgacatattgttttcagaattttatatattttctcatgagctggatttacttttttcccctttcattaaatgtttgtctttggtgcccttgtgaatgcttttaggggcatttttgtttcaatatctcttgagttttgagttgaataaaccatttgttcattcaaaaaaatatatttagcacttgtatttgtagtagttccttatgaggcattcagaaaaaaacctaagcacaaaactgaagaaaatttgcttacctctgtcctaagagaattatctatgtacacacatatgatatatgtacctgtatagatatatacagtcgtccctaggtatctatggggattggttctggccgccgctgtagataccaaaattcacagatgctcaagtctcctaatataaaatggcatagtatttgcatataacctatgcacatctgcctatatacctaaagtcatctctagactattcattcctaatacaatgcctatgcatcacttcatttgagtggactctgcatagtcttcggtgcatggcaaattcaagttttgctttttggaactttgtagaatttttttcccaaatattttcaatccctggttggttgaatccatggatgaggaacccatggatatggagggctgactgtacaattgtattcaatcaactgtttgaatgtatgaaatatatttttgttggtaggtgatgaattttcagaaaatattttgtctcctttagggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaagtaagtggtttctattgcttactatggccttgaatttgctgtctgacctaccaactctaatgatgttaggttgtaaataaaataataggattgatattaaaggtaattaaactgtacaataaaaagtttatttcatctagggaaagaactcttttaagactggttgcttaacataaaaccattagaagtgtatatagaatgccttgcatatcgtgggaagtgagtcagtattaaatgatgatctggcatatgactgctttcaattccttgttatgaactacctacatgctttagtctgtgttttaatctattttaaacatacaatttgaatatagtggccatagtacctaatggcccacatctcactttgtagctacaaagaagaatcaaacagtgctatttatagcatacaaacagcttttacattggtagttatataattatgtaattatataaagagatagatttaaatatcaaatcagaatcattttttttaaaaattatctaaaattaaattgggcacagtggctcacgcctataatcctagcactttgggaggccaaggcaggaggatcacttgagcccaggagttcaagacgaacctgagcaatatagtgagactctgtctctacaaaaaaaaaaaaaaaaattacattagctgggcatggtggcacatgcctgtagtcccagctacttggggggactacttgggatgtgagaatcacttgaacccgggaggtcaaggctgtaatgagccatgatcatgtcacctcactccagtctgagcaacagagtgagactctatctcaaaagaaattatttaaaattagatctcttcctggaatcaccaattcttgcacgttcatgttgatgcttcaaatttttaactaatcttgaactctaaactattttagctgtttatagtatttttcaagggattaactattgtttcagaagaactgattaataaacataaatcactatgaaaatttaatcatacctgcttatacctcttatttgcagtaaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaaggtattcaaagcttaatttttagttttcaaagtattgtttgaccataagaatgaagatagtattgcttaccattaaaagttaactcttctatattatatgatagggttttttttggagttgattgtgggtgtgtgtgtgttttgtgagtttattcatatgcattacataaatagtacccttctctccaggaaatttaattgtaagaaataatagaagttagatttgaaaattatttcttgagattcagataggacttgccctggaatgcttttagaaatgcagagatttttatgtgtggttagtctaactctaaatttctctatgaatagtctagacagtttgggtctgaaattgttaaacatattgtttattttttaaaataacttacagaaaacattttttaatgaagaggcaagttcgtggagtcagtggagcatggactttagaatgaaagtagaacaacccttagacaagtcatatctctcaggacctcagtttcctcatctgtcatttctacctcagagggcacttatgaggaatgggcatgatatgtgtgaaagcactttgtaaaatataaaatatgaggcaaatattaatcattattagtgcctccttcagaagtatgtgtctgatagctgtttgccattatatttggtttgttgaaactgaccagatatcttttatcctgctgaacattctgaacagttgactaaaatgagcatgccaaaggggaaaaggagaggagatgatccagaaatagctagtgaaagcagcttctggcaaggaggatgtcagtatagactatatgggaaagtataagaggaacctaagccaaagtcctatggatagaccagaacaagtgacctagaaggttgtatgatcactacatagccctcattgggtacagttgttcctcttacctgttcctaaactattcctaaaattgatatacatgaggatttgtttgtgagcctccctgcttttatggaaattagatcagcaaggtaaattttttatacttcagtaccaaaactaggtctcagtatgcatgatttataaatagaattctataaggattaagaatcctgtttgtattatattataggtgggcgtttgtttttgtatttcatttctttattggcaaccataaacaaactgttttgccattttatttcccttaaaatacagtctaaaaggctatcaatgagttattcatcaccaaatcggtatttaattaagatataataaatccatttttgtctgtgtgcatttttaggagagcccattgaaaatcgtacatatctacatctttttttctagtaagttaaaaagaacagtaatttattgggacttagtctccaaatggcttttttataaaatggaatatctttattgctctgcttattgtttttacaaatatgtattacttttatagtttaaacaatacagaagcacagtaatgatagttaagtttagcgtatatccttctaggctttttaatgcatgaatttataaatatttgcaaaaataggtctggacatcacacattgttctacaatctgctttttttctcttgtatcatggacaactttctattcacataaatggactttattttatttaaataatagtgaacccacaaaattgcaatttatttgttttattagctttcccagtttgaaaaaaataccatttaactgaggtaaaaattaacatggttgtgtttttctgttcatgtttatccgaagtattttgaaagacatgatgaactaccacatatttaaatagtatatgcaggaagaatgaatttagttttagctttgttggatttgagttagaacttgcattatttacttattatcccagatggcattgctgcttaatgcaattgtttcgtgtgcctagaaaaaattatactatttaaagcaattgctttttacacaaaggctacatttgtctatcagttaataagccctctgtatttattgacacctatcctgtgcccaacatagtacaagcagtattattttatcatacttctactttagattttttaaaacattcatttaaaattttacttcacttaatttttaatatcgtctttaatagactactctttccctctaaatttttatgccacaaattttcattattttattttacttgaactgggtaactcgcttgattttctggtaaccagataggaacattgttgtcttccaggattgattttaaccatagtcacatattatgcctatatgataatataatagtcttctaggaaatcaccccttagagatagtttgaagacctacatgatctctaacttttgtgcattttaatctactaataaaatgaaattggaagaaaagaacaaacaaaaggagtttgcaaggaatcagtgtatttttttctatttcagaatttgttgaaaaatatagcatttttagtgtttaatctgtgtgcacagtgtatgtagattagtcaatataggcatatgtataccttagaattcatttctaaaaattcatttgtgccttatcccattttttctttcctacagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtaatgtaaatttggttacatatcagtttttagtttgaaaatgttatccttcacagagtaaaatgtcctttaattctataaattattaaaacctcaagatgcaatatccttttagtaatttaaaataattattcttcagaataagagtacagccttctgagatattctcagttccatttagtaaagtctttttttattattatactttaagttttagggtacatgtgcacaatgtgcaggttagttacatatgtatacatgtgccatgttggtgtgctgcacccattaactcgtcacaacattaggtatatctcctaatgctatccctcccccctccccccaccccacaacaggccctggtgtgtgatgttccccttcctgtgtccatgtgttctcattgttcagttcccacctgtgagtgagaacatgcggtgtttggtttttttgtccttgcgatagtttgctgagaatgtcatacatttttgaatgatcaagctccattttgcattaacctaaatgcttatcttgtttttaaattttaaagttttaaaattttcactttcagtaagagctgtaagactttactaaatggtaaagttagactatcacttttgatgtactctgtcagaaaaaaataacattgacatcttttacgtaagtcagaaataaattgttggtatttgatactgaatttttacatttgtactgtcatttttaaaggatacatgttagacctttttcttgagaagtgaaataacttgcactgaggttaattgtatgattggtgcaactagtacccaaagtctatttcttaataagtcatactatagaccaaaacttttggccacaaaagagtaagccaaacacattttacttgaaggtgtcaacaataaaggaaaatttaattgacctctatgtttttcaccccctaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactcaaacaaatttataagaaaaaaacaaacaaccccatcaaaaagtgggcgagggatatgaacagacacttctcaaaagaagacatttatgcagccaaagaacacatgaaaaaatgctcaccatcactggccatcagagaaatgcaaatcaaaaccacaatgagataccatctcacaccagttagaatggcgatcattaaaaagtcaggaaacagcaggtgctggaggggatgtggagaaataggaacacttttacactgttggtgggactgtaaactagttcaaccattgtggaagtcagtgtggcgattcctcagggatctagaactagtcataccatttgacccagccatcccattactgggtatatacccaaaggactataaatcatgctgctataaagacacatgcacacatatgtttactgcggcattattcacaatagccaagacttggaaccaagccaaatgtccaacaatgatagactggactaagaaaatatggcacatatacaccatggaatactatgcagccttaaaaaatgatgagttcatgtcctttgtagggacatggatgaaattggaaaccatcattctcagtaaactatcgcaaggacaaaaaaccaaacaccgcatattctcactcataggtgggaattgaactatgagaacacatggacacaggaaggggaacatcacactctggcgactgtggtggggtggggggaggggggagggatagcattgggagatatacctaatgctagaggacgtgttagtgggtgcagcgcaccagcatggcacatgtatacatatgtaactaacctgcacattgtgcacatgtaccctaaaacttaaagtataataataataaataaataaataaataaataaataaataaaatattagagaggacaaggaggattttgatgtttaatatgtctctcatggaaatgcagacaggtcaaattcaaatgaattttcttttacaatgtccaggaaccccaagttttaatagattgatacaacttatcaaattatagctatttgtattttaattaaaattcaaagaaaaactaaatgtgtctttattggctatattattttatttgaattggagtatagagccttttactgctatctccagagtagagattgaaaataatatgctaagtcaattataatgcagtattgataaaactaattttccctttgataattaaaaagcacaatgaaaacatgtaattaaatttttttttccatctcaattccagacgcagaatttctacattggccatcaagggttttccttgccccaactttattatctctcattctcttttagtatgtacccaggatattccttagtttgatgtgggaatacaagtaaaatctgaccagccttagtagttttctctcccaatgctcccaaattcttacttatatcatgttttccttgttctgttctatttcacattcagtccacgtgttagcttcaaagctcaacatatctttctttttcctttaatttgcttttccaaaacctgaagagctgtaactgttccccttaaaactttcatgtgcttttagtagctgaatatgctcagttgtcaagaaaggattttgtttcaaaatgagtttaccatctttccaaatatgcatcagaattctacagttttctagtttctcactcgtttttagaggttttaataaatatatgtacaaaataccagctagtatactatctgcttggaaatatgtatttttaaattgccataatattctgttttcacttaagatttttatcttatcaatgatgaagaatattgacccattttagtatctgtatatatctagttttaataatagtacacgtaaaaacttagtaaagagaaagctttttaaacaagagctagttccatttgatttctaagtaacagaaattatagctatattcttttataactacacttttactaaaacgaagagaaaaattgcattctataattttaataaacctggtgacttttgtacaaacagcaagactttttattttaaatctccaagagtctaaatcaacaagtctaaatatgaatacaggaagtactttaggaaatctttcctgtgagaatgtcaaagacattatacaaagaacaagtcctaccagaagtaattgaaattatgcatgagtaccagttctatccaagtttttatatgggtatatatttaaatgttccacattttaataagttatactaaaatctgggcatataaagagatttagtaaaattctaataaactgcttggaaaaatacatgaatcttttactttcattgacacatataatcaagaactattactagataaggtaatttttcaaaactactcaatgaaagaaaaatgggccctcttaggttagttttaagcaaagtggcctaagaatggaaagcactactgaagatcccttgcctgatgcttttaaactacattatgaatgaattgtagaaactatggaatgtcaagaaaggtagtaattgagtttatgccttaaagtttttagatgggcaaataagtatcttctacatattatcacagaatatgtaaacataacttgtttcatatagttagtaagatagttactaactgtatgtaatatagttattatcttaataagatagtttcataaccaggactatcttactaagtttttaaatagaagtaatgggtttcctacatgataatgtagatcaaaattgtagtttaaccaacataactgattttttcttgccttgataagaataaggtgcttcctatgaccataatataaatttggaaaatgatttttagctgtgggggtagatttatttctaagttgggaaaccagaaactattaaaaatgaaattcacaccctttaaattgtggactatgaacaggatcctatttaagataagcttctgatatttgagaaaagcatttgtttatatttttttgttttaattattggttttacaggtcaactctggcccccaaaccaccatttattataccgagtttatgaagtattctaatttaaatatagtattttgtagaaatttacacataaagaaatgttaatctttgctttgtctttccttcacttttagagccatatgataattgtaaaatcaatgtcagataataaaaatgaaacagattaagaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaagagccagagcaaaaatgttcaaaaactttaagtttagttccttgaataatctactttattacactcttcaaaatttcaaacattaaactaccatctttgaaggtaaatgttttttattttatttcttttgtcatttttttaaattttctaaccacctactgcctgttgatgaaggtgaaggttttaacgtgactttatgaatacttaagaggcaataatggatagaactgacatacttgtcatcactcttataaatttatgtttagggtttcattgcttaagaggttatttttttccctctgggatacttttcctgtagtttagaacaatagataaactgatgattcagtcatttaaattaaaggaatgtgctgtgcttgagatccagactacaaccatgaattttccaacctgtatttgcaaaaatgtaactcctcgttcaaacagctaaacttaatattaagttgtcaagtatgtgatttgtcaaaataagcatttaaaaaaaaaaagaagggaattgttgcaatttgagacctatactctctaatcattaatttttcctttattggcttcttctaccttaccctttcatttacacattgatttgaatactccttaactttccttgaatcctatctatactcatctgttctcacgctgctatgatgaaatacccaagactgggtaatttataaagaaaagaggtttaattgactcacagttctgcgtggctggggaggcctcaggaaacttacaatcatggtggaaggcacctcttcacagggtggcaggagagaaaatgagtgctgagcgaagggggaagccccttataaaaccatcagatctcatgagaactcactcactatcatgagaacagcatgggagaaactgcccatgattcaattatctccacctagtcctgcccttgacacgtggggattattacaattcaaggtgagatttgggtggtgacacagagccaaaccatatcattccacccctggcccctcccaaatctcatgtcatgtcctcatatttcaaaacacactcatgccctaccaacagccccctaaagtcttaattcattcccatattaacccaaagtctgggtccaaaggctcatctgagataaagcaagtcccatccacctataagcctgtaaaatcaaaagcaagttagttacttcctagagacaatgggggtacaggcattggataaatacactattccaaatgggagaaattggccaaaacaaaggggctacaggccccatacaagtctgaaatccagcggggcagccaaatcataaagccctgaaatggtctcctttgactccatgtctcatatctaggtcacactgatgtgagaggtgggctgccacagccttgggcagttccacccctgtagctttgcagggtacagcccccctcctggctgctttcacaggctagcattgaatgcctgcagcttttccaagtgcaaggtgcaagctgtcagtggatctaccattctggggtctgaaggatggtggccctcttctcatagctccactaggcaatgctccaatggggactctatgtgggggctccgaccccacattttccttccatactgctctagcagaggttcccccatgaggactccacccctgcagcaaacttctgcctggacatccaggcatttccatacatcctctgaaatctaggcagaggtttccaaacctcagttcttgacttctgtgcacctgtgacttctgtgcatctgtagcccaacaccatgtgtaagccactaaggcttggggcttgcaccctctgaagcaatggcccgaactgaaccttggcctcttttagccacagctggagctgaagcagctgggatgcaggggaccatgtcctgaggctgcatagagcaggggggccctgggccaggttcacgaaaccatttttccctcctaggcttccaggcctgtgatgggaggggctgacgtgaagatctctgacatgccctggagacatccaaatttggtgattaacattcggctcctgttgcttacacaaatctctgtggctggcttgaatttctccccagaaaatgagtttttcttttccgtcacatcatcagtctacagattttccaaactttttgctctgcttcctcttgaacactttgctgtttagaaatttcttccatcagatatcctaaatcatctctctcaagttcaaagttccacagatctctagggcaggagcaaaatgccaccagtcttttcactaaagctccatttcccaagaagttcctcatctccatctgagaccacctcaacctggacttcattatccatattactatcagcattttggtcaaagccattcaacaagtctatagaagtccattgtccatattactatcagcattttggtcaaagccattcaacaagtctataggaagttccagactttcccacatctttctgtcttcttctgagacctccaaactgttccaacctctgcctgttacccagttccaaagttgcttccacatttctgggtatctttacagcagcgccccactacctggtaccaatttactatattagtcctttcttacactggtatgaagaaatacccaagactgggtaataaagcaaagaggtttaattgactcacaattccacatggctgggaaggcctcaggaaacttactatcatggcagaaggcacctcttcacagggtggaaggagagagaatgagtactgagtgaagggggaagccccttataaaaccatcagatctcttgagaactcactcactatcatgagaacagcatgaggtaaaccgtccccatgattcagttatctccatctggtcccatgcttgacacatggggattattacaattcaagatgagatttgggtggggactcagagccaatcttaatgtccagccctgctagggcttgtactggcttcttggatttcaaactaaagtaccactggattggtccaccctaagctgctacttttcctctgcctcagtcatgggcattctttatcttacttaagctactaaggtttactaaagtttaagggatgaacttaagtgagtcttttcttcttttttttttttagcactcctagtaataacttgcaatagctggtgtagttataatccatagaagctgggtaactgatatgttttaagagtaaaactttggtgttcataaagttttatgtggaaatacaaaagactcagagtaactaaaacagtattgacaaggaaaaacaaagttggaagactcatgctttccaatttcaaaacttattatacagctatagtaaacaagacattgtgatactggcataaggggagacatgtagatcaatgtaatatagttgagactctagaaatacattcttacatttatggtcagttaattttcaacaagaaggccaagctaactcaatgggggaaagaactattttcaacaaatggtgctgaaacaatggacagcaacatactccccacccccaaaaagatgttgtactcttttcttaaaacatacacaaaaattaaattaaaatggatcaaagaccaaaatgtaagagctgaaactatgaaactctcagagaacacataggagttaatcttcatgatcttgaattaggcaattgtttatagatatgacaacaaaagcatgtgaccttaaagaaaaaataggtaaattggattacatcaaaattaaaaacttttgtgctacaaatgatatcatcaagaaagtgaaaagacaacccacagaatggaggaaatatttgccaattatatgtctggtaagggactgctgtctagaatgtatgaagaactcttacaactaaataataaaaggcaaacaacccaattttaaaaatggttaaaggatttgaatagacttttctccaaagaaaataaagaaatggccaataagcacattaaaagatttttcatatcattagtcaatagagaaatgcaaatcaaaagcataatgagataccatttcatacccactagggtggctataattaaaaagaaatataatactgttgaggagaatgtgaagaattgaaactctcatgtattgctgttgggaatgtaaaatggtacaaccctcccaccccatactttctgtcctctaataaccatcattccactctatacttttatgagctcaactttttacctccttcatatgagtgagaacatatggtatttatctttctgtgcctgacttatttcacttaacataatgttctccatgttcatccatgtcgctgcaaatgaaaatgtttcattcttttttgggctgaatagtattccattgtaaaaatttatcacattctctgtatccatccatctgttggtggacatttaggttgatttcatatcttggctattttgagtagtgctgcaagaaacataggggtataatttatatatttgtgcttatttaacattgcatgcctgtatcaacacatcctcataagcaattggtattttcaatgttttgggttttaataggtgtgtaatgttgttttaatttgcaattacccagtgacatctgatgttgaacctctttcatatgattatttgccatttatatcttccttggtgaggtatctatttagatcttttgcccactttttaatgggtcctttatttttttaaacatagttttaattctttgaatatatttataatagctactttatagtctttatttacaaaatccaacaagtgggccccctcaagacactttctattggttgcttttttaagttcttgtttctatttttaagcctgacttccttggatcaccccctgaatcagtataatttagtggttattcagtgatgggttagatttccttaaatgccttatgctaccaaatattctacctttttctcaaggatatctgtgtgaaggtatatgtcaaacttcaggcaattttcacatcagctttagcttttattccctgctttcaaagatagccagagttgagtgactggggctttcttctgtcccatttctttcctaggcatgttcacagccctgtacatgtattcattcttctagatccccaagaatatgttgcagcccttcaaagttccacatcatcatctggtttttcaggtcttccttttaaatctttagccaggctcttgtttgctctagctgaaatcatagccttggacagctgggttgttaccaaccaattgctattgttttctataataccctgggaacagagttttttcaccaagctgagctgtgaataaaatcaaatgataacaacaccctgggaatagagattttccagggagttgcaagtttggtcaaatattgtctatgccctagggatagggcttttaatgaaactccaaaagatccactggttgccatactgctggctttcatttctgagcttgggcaggtggatagagttaaaagacccacagactcttctggtcttactcaggcaggctcattagtttttctcgaataggtgcttttcagtttattgcatgcctttggttaattccagtgttctgaaatggtttattttgaatgttttgccactattttgttgcttttgttggggagtgtgttcacaggggttctgagcttgccattctagaagtcaggttgttgacatatctaattttgataggtatgtctctgagatattgctttaatatttgttatgtatacagattgtggcttataaataacagtaaacattagaacttttttttcttgtagaaacgtaagcatgcatctgggacaactacattctttctttttcagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatggtaggaaaacaaaatatttaaacctatgggctgaaacatttggtgaaaagtaaaaatcttaaaagcagactagaaggtatcacaactgaaaactcttcttttgggacttgaaaagttttccagcaggtactactgtgtaacttatttagttccactgtacacaaggactattatcaggaatgaagataaaagataaaagttggacattggggatttttacagatacataatagtcgtacatatttattgacattgggttttatttgcatggatttctaatccttacatagatgtgatttggggagaatgatggtttaaagctttgcctcccaagtataacacttttaccatttttatatgagtttagctaagaattaaaatagtaaattaagctgctatgctcacatgagtttaaaagattttcatgatgacaaggattcagtgtttcacccctgggtgaatactgattttggttttctatgttcttaatttctatagatgttgtttcaaggtaaagagagtgggaaagttattttgcagaagttaatttctcactaaatttagttgttttgatttttctgtcattacagttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtattacgtttattcattgtatttatttaatagacattaactatgcctttctaggagttatgccctaagctaaagcaaaagaattacaaagatggttaatacaaagtcttactcatcttgagttcggactagtcaaagaaagaaaggtaagtagttatctataccttacctatctatccacacatccagcatctgagcacattagtttattaggcaagatatgtatactgggggaatctttagtgtcaacagtcagttaagggggaaaaaagctcatgaaattggtattctgttggataaattagtagcttgacatagattctagtgtaaagctcttttctgtttgtgctcagaaatcacttaagcataaggctaaatatcaaggtaatgaaatccaattatttatgtatatatggaaatagcttcattatatccaccttctgttgtatgttaatgtaataatcttcacaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggtatgacttaactatgagcccaactgtgtgtatgttccaaataaaatcacatcaaatccaattccactaatttggaagtggcgattataaggaaagagatgggggtgagatagatagagcatagtattaatgtaagtaggatggtagtgggaatacttaggagaattgatatttcattatttttctttttcacttaacaaatgtttattgaacttctgctctataaaagatactctgctaggtacttaaggctatataaagatgtatcagataagggtcctcccttaaaagtatgtagaccaggagacattaaagcatattcattaagaaacaaaaatcaagtgagaaaaactgttagagaaatataaattcctgtcatgatttataacaaggagaaactatttttcatctggaggagtcagagaaggcttcgtggaaaaggtagcatttgcaagtcttaaaaattggtgaattttggacatatggaaatggaatgaaaagaacatgccaggtgatggaatccatgtaaccgaacataggtagaggtaaacgtaaagtatgtataggaccatgtttgtttagtttggtagaaacatagggtggatgaagtgaagtagttggagaaaaaaaatcaataaggtagattgggatagagctggagtttgaattttattttataggcagtggaggaatcattggaaaaaaattatttaggagcacacaatcaattaggataggctagactgctaacacaaacacagataatagatgaaacagtataattttatttcttgaaggaataaacaaaggagattgactcttcaggtcagtaggcagctctcctccatgagattattcaggaacttagactgtagactgacagcagactgtcattttcaaaacaaaccttcccgagtacattttcatcaccattagcactcacaggaacagggaaagagcatggagaaacaactgtgaaagattttatgggctaggcttgaaaggggcaaatatcacttcatgcacattctattggatgatcttagtcacgtggatacacctattcacaaggaagtctgtggagtatagcgtggctgagcagacatgagcagctactatggaagaagaggagattggaatgtcatggataggtagcactctgtgccatacgtttatttataatgggttgaatacctgtaattgttacatgtcaatactacctatccactgtaacttgtcaatagagattttttttttttgaaaaactgtttaagtgaatggaacatctaaatggcaaggatttttagcatattttaggatctctgaaaggtacaaaagaagcataatgcttcttttctcaaagagcttatactcacagaccctgtgatattgtctataagcagtagtttagagatagcttcaaaataggcagcacttaatattgacttctaaaagatgagagcaaagttagaaacatggagggcaggaggaaagttatttggggctaaagtatgagtgataccattcaggtgagaataagcccaccttgggagataagattggctaggttcacattggaataaaaaagtaaatttgtatggcacaagatcatgaagaatctttcaagcctgggaaaagaatttaaacttaatatggtagacagattttgttggttttgatcaaaaacccacgtgagacacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcctactaccaacccaagcaatcactgatctactttctagctctatgaatatgcctattgtgcacattttatataaattgagtgatacaatatgtgatcttttgtgcctgccttcttttacttagcatatcattttcaaagttcatccatgttgtagcatgtatcaggacttctttcttatgatttaataatattccattatatggatatataccacattttgtttattcaatgttaatagttatttgagatgttttcttgttttggctgttgtgaataatgctgctatgaatattcatgtacaagttttttatggacattgctttattattcttgtgggtaaatatcttgaagtgaaatttctgggttatatgataactgtctgtttaacattttggcgcactgtcaaactattttccaaagagactgcaccattttatattccctccagcaatgtatgagggttctattttttctttgtctttattttattttatttttttaccaaatctccccttcattgtatgtacaaggattctaatttctgcacatccttgacaacacttcttaattgtctttctttttgattgcagccattccggtgagcgtgaagtggtgccttggcactcttgttgaaaattagttgaccataaatgttagagtttatttctggactctcaattctattccattgatttatacttctacccttataccagtgccacattgtcttgattactgcatctgtgtagtaagttttgcaatcaggaagtgtgagttctttaactttgttcttttctaagattgttttggctcttttagttccttgtatttccatacaaattttaggatcaacttgtcaatctctgcaaacaagaaaaaaaaaaggcagctgggattttgatagtcatcatattgaatctgtagatcaatttcgggagtatttcatattaacaatattaactcttccaacccataaacacaagatgtctttccttttcatttatttaatcattctttaatctgtctcatccaaagatgttttatagttttcagtgttcaaggcttgtacttcctttgttaattttatttctaagtattttaattttttgttattatagtaaattgaattgttttcttgatttcatgttttgattgtttgttgccagcatatagaaatacaactgataactgatcttgtgttctgtaagtttgctaagcttatttattagttctagtagatttttttgtggattaattaggattttctatatacaaaatcatggcatctgaatagtgttacttttacttctcttattccagtatggatgtctttttttcccttattcttgcctagttgaccaggctagaaccttcggtacaatgttgaatagaagtggtaagaatgcatgtccctgtcttgttatttatcttaaggggagtaatcagtctttcaccataaagtataatgttaactgtgggtttcttgtagatcatctttatcaggttgcggaagttctcttatattgctagtttgttgagtgtttttatcatgaaggagtattgattttgtcaaatgatttttctgtgtcaattgagatgatcatgttattttttccatatatatatatatataaacatatatatataaacatatatatatatacacacacacacatatatataaacattgatggattgttatatgttgaatcacttttgctttcccagaataaatcccacttggccttttgggatcctttttatgtgttcttaagttcagtttgctagcatgttgttgaggatttttatgcttatatttgtaagatatattgatatatagtttttttgtgatgtcttcgtctactttgggtgtctaggtttcttagaataagttggatagcgtttcctcctttcctattttttgaagagtttatgaagaattggtggtaattattctctaaatgtttggtagaatttgccagtgaagccatctgctcttagagtttgctttgtggaaagttttttcattactaagtcaatctctttatttattataggtctatttcacttttcccattttagtttcagtagtttgtggttttttttagaaactcgtccattttatctagattatctaatttgttggcatataatttttcatcataatcacttataatcttttttacttctataaggttgatagttctctatttcctggctataataatttgagtcccccttctcacactcttgctcttgcacactctcacttttgcactcttgatctctcactcgcactatctcgttcttgctctttttttttggaaaatttttttagttaggctacctaaaaatatttctatgttttttatcctttttgtcttttttaatcttttcaaagaaccaacttttgcttttgttgatttttctctatttctagtcttttttttaattatattttaagttttagggtacgtgtgcacaatgtgcaggttagttacataggtatacatgtgccatgctggtgtgctgcacccattaactcatcatttagcattaggtatatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcagttagaattatttctagtctttatcactttctgctcgcacaaagctggaagattagctggagataagagcttaggtcttttctgttctttcctaagaatacatacaactgtgagtatacataaagccatatgcatgtagttggccttctgggttcccaggaatatgtcacagtttttcaaagcccccacttttcttttaacactttgttagcgtattgtttggcccaactgctatccactgccttggatagccacatgttcaacaactgcctctgattgttttcaacaaacaccacaggggaaaaggctgtttacaccagaggagctctgtgtcaagtcaaataaagacagtcttgtgagaggagtcttccagggaaccactagacaagtcaaataacaacaattatttgggaatggggctttgctggagttccaaccccaatctgttccattcagtagctactaggtactggtttccactgtaattgctagatgttggtttctttcttttttctctctctctctcttttttttttttttttttttttaatgatagagtctcactctgttgcccaggctggagtgcagtggcatgatcttggctcactgcaacctccacctcccaggttcaagcgattctcctgtctcagcctcacgagtagctgggattacaggtgtgcaccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaagtataaaaatgagcaatggacatgaaaggattaatcacagaagagaaaatacaggttgatgttaaagtctgaaaaagaaagttcaacctcaaagaaattaaaattaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacagtgtgatacaaattttaggagaaaaaggaagaaaaaactgcagaaaaatatatcaacttgttaacagtttatttctgggtacataggatacaagaggttttattttctcattcatacttttccattctctccaaattctatccattaaggatttattactttataataagggatgtggcaatgtatataaaagtaatgatctgacatttgtatgcaagataggtaagaagcagcagcaagttagagtggtagtgggaatgggaaggaaaaagcaaatccgaaagacgttttataagaagaaactctaggatatgaaacagatgcagcagatagagggttttcagcataatcaaaactaggataggtaagaagaatcctacttgataggggaaagaagatattcagttttggacaaaattgaggatgattcatatctgagggctatttctttataggtagttggaaatacagatgaagttcgttttctttcgttttagtatgtctttgaaaattatgtaggcttttttcagattagtgataattaaggtttttcactcttcgaaattagagaggttttgcttattatgttctgtatttattatattactgcttcacttttcttgaatgttactttataaaataactgattatcaaatgttagcctgacttcaccttgttttgccttggactggctcagagttctcatgtttccactgttattacactattattactctcagttgttcttgttgctgtcaaaaactattatgtttgaagaagtataattattacttgagcaatatttgctttttaatactgttttctatgaattttaggcaatgaatattttgacttcagtgctgcttctatatgcaaaagaggaagaagctttttggcttctggttgctgtatgtgaacgaatgttgcctgattattttaatcgtcgaattattggtaaaagaaaaaccacacacacacatatgcatacacacacagagatgtatatttcctttctaaacaatttcagtgtctcttgtctaattactaataaagtagaaggactgatggattatgttgtggtataaaatgcaagcaatatcaaaatgtcacattcactgacattctcaaaagaagagctttttgtactgaatgtatagtcagaaagattgtttaatatgttgcttttaaaaataaaatacctggtctgtttcttaacaaaaatggaagcattaagtttataaactctatgttgctaaaacaatggtgatctcaagtatccacagctactggtgaatttttgtagttttttgatgggagggagatttcaatctgcttaaaatctccatatttgtatgaattatatagatatttgcaagatttcaaagaaggatcgagttcttagtttgttaattgtataatttttattttattttattttattttattgagacggagtcttgctctgtcgcccaggctggagtgcggcctcggcttactgcaagctccacctcctgggttcacgccattctcctgcctcagcctcccgagtagctgggactacaggcacccgccaccacgcctggctaattttttttttttttgtatttttagtagagacggggtttcaccgtgttagccaggatggtctcaatctcctgacctcgtgatccacccacctcggcctcccaaagtgctgggattacaggtgtgagccaccgcgcctggccaatattttctttaatcatcaaatatttacagatctgtgaccacttaccttaaaacttatgaatggtctctttgtaccgtaataggctttcaggattgtggttaggtcatcgattttactgtctttcattataattatttgtgtattttttttttttttttttttttaggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatgaatttgaattgtgtttctgaagtacatgacactactagcagttagatgtataaaatacagaagaggttctgaaagagttcataatttaaggaagaagaatgagatacatcagcatgctaatagaagtggggaggtatggaaacaagtccttttgaaaaatgtttatttttaaacttcttttgatattctgtaggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggtattgtaagaaccataacatttaaatctggaggagatttgagagatgatgttgttcaatcccctattttacagaggaaactgagccctagaaatttcagtttgtccgagattacaaaaccacttgaatgaaagagctacacctaaagtccagtcctctatctccagaaaaaatatagcaagaataaatcactttgaagtgaaccactaaattatgtacacatttacactaatattgttgattcagtatgctaggactttcatattcccagtttgagctataaagtgtctatgtagaattagttcaagcaggaaaagcatagttgataatgttaaatatccagtggccgggaagttattctggtttctatgtggtttcaggtgggttgaactttattttcctagtagcttctgtatgaatgctattttgtattggagcacatgtgttgtatgtgtgtgtatgtgtatatgcacacatttgtatatgctaaatgaataaatttgagtgggcaactatcataatgccacatgaaatcccattatgtacagaataaaatacaaacatcttactctggcattcagaactctgtggtaagggctcagtgtacctttcttcacttatttccccctatatgcttctacataccctatattccactcttactgagctgtgtggtatttgccaagtactctctgagcctgtttgcttccttcaaaaccccaaaatgattcctacactatcccatttccctcacccatgccctcctaatgctcaaccatcttcaaactccacttcttgaccgggtgcggtggctcatgcctgtaatcccagcactttcggaggccgaggcaggtggatcacctgaggtcaggagttcaagaccagcctggccaacatggcaaaacctcgtctcgactaaaaatacaaaaattagccaggcgtggtggtgaacacctgtaatcccagctacttgggaggccgaggcagaataattgtttgaaatcaggaggcggaggttgtagtgagccaagattgtgccattgcattccagcctggatgacagatcaagactccatctcaaaaacaaaaaacaagttccacttctttttttgttattattatactttaagttttagggtacatgtgcacaacgtgcaggtttgttacatatgtatacatgtgccatgttggtgtgctgcacccattaactcatcatttaacattaggtatatctcctaatgctatccctctcccctcccccaccccacaacagtccccagtgtgtgatgttccccttcctgtgtccatgtgttctcattgctcaattcccacctatgagtgagaacatgcgatgtttcattttttgtccttgcgatattttgctgagaatgatggtttccagtttcatccatgtccctacaaaggacatgaactcatcattttttatggctgcatagtattccatggtgtacatgtgccacattttcttaatccagtctatcgttgttggacatttggggtggttccaactctttgctattgtgaatagtgccgctataaacatatgtgtgcatgtgtctttatagcagcatgatttataatcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcacatgcctatgtcctgaatggtattgcctaggttttcttctagggtttttatggttttaggtctaacatgtaagtctgtaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgtttttgttactgtagccctgtagcctggtagtatagtttgaagtcaggtagcatgatgcctccagctttgttcttttgccttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacctatgagcatggaatgttcttctatttgtttgtatcctcttttatttccttgagcagtggtttgtagttctccttgaagaggtccttcacatcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcatctgcaaacagcaacaaagttccacttcttcataagaccttcccttgtcctctcagttgaaagtaacctctaactaactagggagaaattatgtgtcatttctctgctttaataatggtagttccactaattcttgtattactatcacttttcaataggttctttgacaatgtcactaataaggatagtccattgccttcaaatgttcagcaaggttcaaatgtgagtgatgaaaaaaccagtcatactagagtggatattacagatttgattagagaatcaaatgaggtaagttttttcatgccataaatatattagctagcatatttaaaatgattgaactatggtctatctctaatggtatattaagtgtaagataataatgcaagtagacatacaacttaaaatccaacttaacttttaaaatgagttctgtgaactgttctaggttgtgtaacctcctctgcctcaatttgtttttcattaaatgaaattaaattcacttgctttcacaaataatgaccactttaaacatctatcactggattaaaaggtgaattattctcattattattattcacttcttagagattaagaattttacctatatttttgtacttagtctattcacatagtagatggaattctctccagtgaatatatttaaaaactgaaacgtgggaggtaaaaatttgcaaaatcattgaacaagtcaggaaattccctagaaatagaatcaaggcctccaagaattcagtctgataaaactgaattgtaaaagaaaaagtggatgtttattatgagtgagtagccactgaaatcatatctcttgcagaaatatggtaatattcgctatgaagatatacatagtatgcgctgtcgaaataggttgtatgtgatacagaccctagaggaaacaacaaaacagaatgtggtaagtatgcaaccaatgaggaaaaaccagttggagtaattttttttttctataactttctttagaaattatcttctgggcgaataaaatgaaaaggactaaacttttgagctagatccttgccaaggtttaccctatggtaaattcttttttagagaaaatacattattttcttctggttgaattatgttgctttctccaacatgttttgtactatttgaccttcaagaccactgagacagggtctcgttctgttgcccaggctggagtgcagtggcatgatcgcagctcactgtagcctctacctcatgggctcaagagatccttcttcctcagcctaccgaggagctgggactacatgcacacaccaccatgcctggctaatttttaaattttttttttagagatagggtctcagtatgtttcccaggctgtctcaaacccatgggctcaagagatcctccttgcctaggcctcccaaagggttaggattacaggcgtgagctaccacacctagcctgcagctcagtgttgaatgctatcatgttggcatttaagcataacatatttgtgatgtgctgcatcagtaagaacagccgatctacatagtagtcagtgctccaatgaatattattatccttggatacctaaagtaaatactatgttttaaatacttgtctttttaatatttggatggctccataagcaactgttaatattggttgcctttggtgaatcggattaatagattgctggtcagaaggaggagagttttactttgctgtttatattcttctgtactgtttgagcttttatcatgaccatgtgttgtttttgtaaacctacttgcttaaaggccaaggtcctcagagatacaaatctgggaagattaatgtttctgaagattccaggtttagatttcaattgaataattcagtgaggttactgtgacatagttagcatagggccccttgttttagtttttatatgttagcatttttaaaaatttactgaagtaatacatgctcactgtaaataatttaagcattacataaatgtaaaaagtagattccccaccccagaagtaaccatcttaaaataatttggcatatatcctttcagatcttttatctaggtgtctgcacacatgcatgtgtattggaaggatatagtttttgaaatgagatcataccagtcactttgctctgcaacttttttcattcagaaatagatcatggttattgaatatcagtaaatatagatctacctcactcttcctaatgcattgaatagtatgccataatatggatatgctataatttattcactgctgatgtacatttaatatgtctcccttttttgctcttacaaataatactttatgtaaacattcttgtatatctattctttgcaagatagatatctggaagtggaagctgggtaaaagggtatgcccatttaaaatttgacaggtccctgccaaattatgcttcaaaagattttgccaaattgtaatcccaccagcagcctgtaagaatgcccctttccccacattctcactaacaccagatatttaaaatcttgaatttgttggccaggcatggtggcacacactcgtagtcccagctactcaggaagctgcgacgggaggatcaccttgagcctgggagttccaggctacagtaagctataatcatgccactgcactccagcctgggcaacagagctagaccttgtctctaaaacaaacaaaacaaaacaaaatcttcaatttgtgccaatgtgatagatcaaatacttttaaggtttcaattcactgatcacatatgtttattagcctttttaatttcttctcttaattgcctattcatagcctttgcttatttttctatgagattgtcttaagtattgatttgtagaagctcttttgactattagtagtaccagttctttgtcagctatatttgtggcctaatattttcccctagtcttattatttctttcattatctttataatgtctttcagattatacaagttacaaattttcttgaagtctttctcttttttattacatgatatctgggtttcatatcaaacttagcaggctttccctatttaaaattatataaattataaaaatattttttcatattggcctatagtactggtattgcttttttaacatttagaactttaatatacctagagtatatttttttattatgtaatattatgtttttccaaccaaaatcactcattttctaaaaaccaattattaaatagtttatcctcacagtactctactttcttcatatgctaaattcttatatacatacatgggctttatttttggactctctttttttgttactacaacagtaccacactctttcaattaccatagtttgtctactttgaaatctggtaaggcttttattcattttaacagtctgtctttttaaatgttctttagtaagcattttaattttcatcatctaggtcttacacatttcttattgggtttattctacccctatatattttatggttttgctgctaatatgaatgagatcatttttcctttacattgcctaattctttattggctgtgtgtgtaaaagttattgatttgggtatgttgcttttctaagtggtcgcattattgactctcattaattgtactattttttttagttgacctcgaattttctgaatagacaagcatgtcatttccagtcttagaattttgacccttcctaacatttatacctcttttcttttttctgtgttattgcattaagtaggatcttcagagaattattgaataatagcagtagaagcaggcttctttgtcttattctttttgttttttttgagactgagtctcactgtcgcccaggctggagtgcagtggcacaatctctgctcactgtaacctccacctcctgggttcaagcaattctcctgcctcagcctcccgagtagctgggattacaggtgcctgtcaccatgcccagctaatttttgtatttttagtagagatgggatttcaccatgttgactaggctggtctcaaactcctgacctcaggtgatccacccgcctcagcctcccgaagtgctgggtttgcaggcatggccaccacacccagccgcaggtttgttatataggtaaattatgtgtcacagggtttcgtgtacagattatctcatcacacaggtaataatggtactcaataggtagttttttgatcttcaccctcctcccaccctccatactcatgtaggcccctgtttctattgtttccctctttgtgtccatgtgtactcaatgtttagctcccacttataagtgagaacatgcagtatttggttttcttttcctctgttagttcacttaggataacggtctccagctccatccatgttgctccaaagaacataatattattcttttttatggctgcataatattccatggtgtatattgaccacattttctttatccagtctactgttgatgggcatctaagttgattccatgtctttgctattgcaaataatgctgtgacatacatacacatacatgtgtctttatggtagaataatttatattcctttaggtatatgcccagtaatgggatttctgagttgaatggtagttctctgttaagttctttgtgatatcttcaaactgctttccacagtggctgacttaatttacatttccaccagcagtgtattagcattccctttactccacaacctcaccagcatcttgttattttttgactttttaataatcatcattctgattgtgtgagacggtatctcattgtgattttgatttgcatttctctaatatttagtgatgttgatcatgtgcttgttggctgcatgtaggtcttcttttgaaaagtgtctgtccatgtcctttgcccacttttttatggagttgtttgatttttgggttttgttttttgtttttgttttgagacagagtcttgctgtgtcacccaggctggagtgcagtggtgcgatcttggctcactgcaagctccgcctcccaggttcacgccattctcctgcctcagcctcctgaatagctggaactacaggcatccgccaccatgcccagctaattttttgtatttttagtagagacggggtttcaccacattagccaggatggtctcaatctcctgaccttgtgatccacccgcctcagcctcccaaagtgctgggattataggcatgagccaccacacctggcctggtttttaattttttaacttcctatggattctggatattagacctttgtcagatgcatagtttgcaaatattttttcccactctgtaggttgtctgtttactctgttgatagttttactgtgcaaatgctccttagtttaattagtcccatttgtcaaattttatttttgttgcaattgcttttggcatttttgttgtgaaatctttgccaccgcctatatctagaatggtactccctaggttttcttcaaggctttttatagttgtaggttttacatttaagtctttaatccatcttgagttgatttttgtatatggtggaaggtagggatctagtttcaatcttctacctgtggttagccagttatcccagcaccatttattgaataggttgtcctttccccattgcttgttattgttgactttgttaaagatcagatggttataggtgtgcagctttatttctgggcactccattctgttccgttagactatgtgtgtttttgtacctgtaccatgctgttttggttactgtagccttgtagtatagtttgaaggtgaataacgtgatacctctagctttgttcattttgcttagtattgctttggctatttgggctcctttctggttccatatgaattttctagaatagttttttctaattctgtgaagaatgtcattggtagtttgataggaatagcactgaatctttaaattgctttggttggtatggcctttttaacaatattgattcttcctatccatgagaatggaatgtttttcatttgcttgtgtcacctctgatttctttgagaaatgttttgtaatccccattgtagagacctttcacctccatagttagctgtattcctaggtattttactctttttttggctattgtgagtaggattgagttcttgatttggctctcagcttggactttgttggtacatagaaatgctactgatttttgtattctgaaactttgccaaagttgtttactaaatctaggagcttttgggctgagactttggggttttctacatatagaatcatatcatctgcaaatagaaatagtttgacttcctctcttcctatttggatgccttttatttctttctcttgcctgattgttcgggctaggactgtctgtactatgttgaaccagagtggtgagagtgggcatccttgtcttctggttctcaaggggaatgcttccagcttttacccattcagtatgattttggttgtggatttgtcataaatggctcttattattttgagatacagttcttcaatgcctagtttgttgaggctttttaacacgaagtgatgttgaatcttactgaaagctttttctgcatctattgagacgatcgtgtggtttttgttttagttcgtttttgtgatgaattgcattaattgatttgtgtatgttgaaccaaccttgtatcccagggataaagcatacttgctcatggtgtgttagcattttgatgtgctgctagatttggtttgctagtagtttgttgaggatttttgcatctgttctcctcaaggatattggcctgaagttttctcttttttttgttgtgtctctgccagttattggtagcagaatgacactggcctaaaagaatgcgttaaggaggagtcatttctcctcaattttttgcaatagtttcagtaggaatggtaccagctcttctttatatgtctggtagaatttggctgtgaatccatctggtactgggctttttatgattggtgtgtgtgtgtgtgtgtgtgtgtgtgtgtgtgtgtgtgtgtgtgtttctgattcaattttagaacttgtttttggtctgttcagggtttcaatttcttcctggtccaatcttggcaagttgtgtgtttccaggaatttatcatttcttctaggttttctagtttgtgtacatagaggtgttcatagtagtctctgagggtattttttgtatttctgtggggtcagtggtaatgtctctttgtcatttctgattgtgtctatttgtatcgtctcttttttctttgttagtttagctagtggtctatcagtcttatttattcttttaaatagccaactcatggattcattgatcttttgtatgggttttcatgtcttgatttcattcagatcagctctgattttggtaatttcttgtcttctgctagctttgggattggtttgttcttgttttcctagttcctctaggtgtgatgttaggttgttaatttcagatctttctaacttttttatgtaagcatttatgctgtaaacttccttcttaacactgctttaactgtgtaccagagattctgatatgttgtatctttattctcattagttttaaatatttcttgatttattccttagtttcattgcttacccaaaagtcattcaggagcagattgtttaatttttatgtgattatatggttttgagcaatcttcttagtatttattttcatttttattatgctatggtccaaagagtatagttgttatgattttgggttttttgaatttgctgaggattgttttatgtctgattgtgtggttaattttagagtatgtgccatgtgcagacgagaagaatatgttctgttgttttggggggaaaagttctgtagatatctgttaggtccgtttggtcaagtgttgagttcaggtcccgaatatctttgttagttttctgccttgatgatatgactaatactgtcagtggggtgttgaagtcccccactattattgtgtagttatctaagtctctttataggcctctaagaacctgtttcatgaatctgagtgctcctgtgttgactgcatatatatttaagatagatgtcttcttgttgacttgaatcctttaccattatataattccttttttgttttgttttgttgttgttgttggcctaaagtctgttttgtctgaaatcagaatagcaagccctgcttttttctgttttccatttgcttggtagattcttcctcaaccttttactttgagcctttggatgtcattgcatgtgagataggtctcttgaagacatcattcagttgcatctcactatcttatccaacttgccactctgtgccttttaattagggcagtctagttacattctggttagcctgtttacattcaaggttaatattaatatgtgtagatttgatcctgatatcatgttgttagctgattattatgcaaaactgattgtgtagttgctttattgtgtcaatagtctatgtacttaagtgtgtttttgtagtggctgataatcgtctttcctttccatatttagcactcctttcaagatctcttgtaaggcagatctaatgaacatgaattcccttagcacttgcttgtctgagaaggatcttatttctcctttgcttatgaagcttagtttggctgaatacgaaattattggctggagtttcttttctttaagaatgctgaatataggccttcaatcttttttggcttgtagcatttctgctgaatagtacactgttaggctaatgggatttcctttttaggtgacctgctccttatctctagctgcctttaatattttttctttcatgttgaccttggagaatctgatgactgtgtggcttggggatggtaatcttatatagtatcttgcaggggttctctgcatttccagaatttaatgttgtcctgtctagcaaagttggggaaatgttcatttatttttgtctaagttaattcagagaaccagtcttcgagttctgagattccttcctcagcttggtctattctgttgttaatgcttgtgatagtattatgaaattcttgtagtaagtttttcagccctatcagatcagtttgattctttcttaaaatggtcattttgtctttcacctcttgtatccttttattgtattccttagattccttggattgggtttcaacattctcctgaatctcaatgatcttcatttctatgtagattctgaattatatgtctgtcatttcagccatttcagcctggctaagaaccactgctggggaactagtgcagttgtttggaggtaaggtgacactctggttttttgagttgccagagttcttgtgctggttctttctcatctgcgtgagctgatattcctttaatctctgaagttgttttcctttggatgggtttttttttgttttttttttttttttttttttttttgcttttatcttctttgatgcccttgggggtttgattgtggattcagttgactggctttgattttgaagatttcagatggccaaggctcacctgagctctcctgagatgagtgtgctacctctgcggggctggtaccagacccccagctttgttctctgggccctcggggctaggaacctgctctgccagagaggccaaggtgttcccagtccactggcctcaacactacaatggaggtgctagccaaaacacttagtcggggtggtggcggtggaatccatgcttgctcgtgcatgccagcatccgtggcagcgtggcagcatacacatgcattggctcaggctgggtgctcgtaggagcctttaccttagttttcacaggtggtgtatactggcagaatattttagtgttgtcttttgggctgcgatccagtaggtggcgcttaagagtgttagccagcagatagcttcttgctctgctgcatggctccagggtaatggtctgtgaatggggacagggagatggcccattcacctagtccacccctgggccttggaggaaccccttctgattactggcttcatgcccgcatttcttttgttgggtgctctggtccacagggctccctcaggtaggagccacagttggcaaacaggtcttatccttactgggtcggccctgtggagggaggcacacaccacccctctatcaagctgcgaacctgggtgtctcatctctcagtgatgcttgggcaccacctaagtcagaaagtcccgcccaactgggagctgcgggagtgagtagtgtcacctaatctgctgtccaagtgcatcctgagggtaccaggggttgcaactgccagcagagtttaggcagaagctggaccactggactggaagctctaacaggcattgcccacctggctaccagtggtggagcgtggtggggtcacctgccctgcctgttgggtgtttccagtgacaacaggatgttgcagccactggctaagttcaggcagaagcgggacatctgggctggaagctccagcaggtgttgctcgcctggctaccagtgacaggagcaggtggggtcgtccgccctgccgtgtaggtgtttcatgggacaacaggaggctgcagcctctggccgatttcaggcagaagcggtagtgctgggctggaagctggcaccaagccttgtctggtgaggagggtggaccaatcctactgctcccaggcaccatgactttggcctctattggggctgtggcgctggtgttggtctgttccaggatccgaggcttgtagaggtccccttggacttaagagttgcctctgcaaaccgtctgggtggctctctgcctcagtttagaggtgaggtgggaggatgagagtggcaagtagggggttagggcaggggaattctcccactcccagccttacacagatccccatggagagtgtgaattaccctctcccgtattggggagcttctcctgactccgcattgatgccagataggctgctgcccagcttccctcctctctgctctctgtgtccccttgctgctttgatggttcccagtgtggtttcttagatgattggcttttagggtcagtgttcactaaaccctttgtttcccctccataagagagcagcacccatgatctgcttctagtttgtcatattggcccctcccatgctgggcaccttttttttttttttttttttttttttgagacagtctcactctgtcgcccaggctggaatacagtggcatgatctcggctcactgcaacctctgcctcccgggttcaagtgattcttgtgcctcagtctcctgagtagctgcgattataggcatacgccaccacacctggctaatttttgtatttttagtagagacagggtttcaccaagttggccaggctggtcttgaactcctggcctcaagtgatctgcctgccttggcctcccaagtgctgggattacaggcatgagccaccattcctctgctgggcactttaaatgacttctgtatccatgcttaaattatccacttctcgatgatagtcatttgtgatttctttcatctcacttgccagaaatgtgtctatcttattgattttttcaataaaccaactcttaattttatttactgagtctaccgggtttttttaattttctgtatttcatcaattctagcttttttctttacctttgctttcaaatttcttagatatcataatgattgtatcattagtccttcttcttcatggaataggataaaagtacatattttctaagcttattacttcttggattatgttttttggcatagagagggaatgtacatctcccaatgcctttgaagtatttaatagcaacctcacatgatgactagatatgctgcttatgtggcaagagaggaatatatggaataggacttagaatactgttacttatatttatagacattaagtggctgttctttggcagtgatttctgagtatgaagagatgaatatcaaagtacatattagagtagaattgaactagtctactactactttttaaaaggaaaaatagataataactttataatataataacttataataactttttattattcatttaagaagttaaaacacaaatattttcttctagcagagagagactctaaggtaattcaaagagaatttctttactgcaatgttaaaatctgtgtactaaattgcttttaatctttttaaagttgcgtgttgtatcacaagatgtgaaattgagccttcaagaattggatgaactttatgtcatctttaaggtactgttgttcttctttaaatgaaaaataatgcttttttttagcagaattgtatcacagccattctaattatttttatctttattttagcagacatggtttttaaaatcttccaaaattactttttctaattagtaactttccttttttatttatttttaatagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttcccccaccccaccgacctccccgtaaaaattcaaccacatagcctagaagagtggtagataaatacccagcaaacatgttgtacctacagatagtcaagatgttgtacctgtagatattgttcatttgcttttccagataccccagcatgctttcttatcagggatcaccccttgaagaacagttctctcctgcacaggcctcattcaaaagaaaagagaaatctgagattggggggaaggagctaggaaagagaacattttacttttttgataaagagtattttgcttatacagttatacacttgaaggagagcatctgattgactaggtggttgtttaattgttagcttaagtaacaggtttctaaatcctaatttttgactaatgtctatatcttaattaatctttgttgctgaaattgattgaatgttctttagatacatgattatttacaattgaattttattgaacagacataatgtacaatggaagttttactgagaagcttaagctgctttttaagctacatattcctccaggtaagagtttaccagtctttaacgatgtacagcaggaatttattccattttagcaagtataattacagatttttttaacaactaaactaattttcaacatgatataagatcgttgcttcactgtggccctcaaattatattatgactactttttgctgatatagatacagtgatcttctatggaagagattctgtgtaacatatgggcccacaagtttccttcctgttagtagtcaatttaatgataagtagtttgtatataagaatcacatatcatttgattgttggtataatgttgaattgttgttgttgtcattagagtggaaattaactttagacaaactgccaaacctgcgaaatactacaaattattcagaaaaatgggacaaggaagcagggatattaaatattttaaaaaggaagcacaataaacgctatcatttattaagcacctgctctgtcaagacattaactttacatgcatttttaaaatttaattctcataatatccatgataggtggcattatccttccaattttgatgataaggaaactgagagctggaaagataaaaatttgccaaagatcacatcgctaataaattgcatagcaaactgaagtctgactccaaagctcacatttctttatattcttccgtactacctcaaaattaccacaccattcagtttacttgtttttcccactgacctgaagaggatgccttgccaaagcctgatccctactttgtgaaaacagtcttaggctttaaactgaaggagcattgcaaaaagtaccttttagccgagatggggtagttcacaaaaacaaacagcacctcataatttgtttaaagctacacctgggatcccttttcagcttttctcaggatagccgggaaacattctttaccacaccaacaaggtaaaggccatctttaacccttcacacactcaaatcacaaacacatcattaaaagcaaaagacaaatcacctaaaaatttaattataaaaggagtttccattgtcaaatcaggctactgttagaatgtttaatattgtcatcaactatgcttttaacagagggataaaaaaataggaaaaacattatgtacctgttaaagcacaagtaggaagtaaaccaaagcacccaactttctgttttccttattattgaggatgttttttaaatggctgaggtcacattttcagagatttctaaatgccagatttaaacaatttcaacttttaatagctcttggaaaaccattaaaaaaacaagtaggaaaaaaatagaactcaaaatgatcaactacttcttgtatttactatattttatatatattacatatattacagtataattactatatattacagtagagtagaaccacttctgtatttcttcacttacatctttcttatacagaaactctttaacacccagttcccagatatacctgacccattatgaacctcatctctgcccctggttgttaataaatgtaatttgggttatttatatgttttcagcttacactgaagtgaaatctaaggatgcttcaaaaggagatgaactttccaaggaagaattactttatttcagtcagctgcatggtaaatacctgtttaaaatgttaactgttttgatgattagccacccataaagatcttgctgacttagatatactttacccaactaaaattgggcttcattttaacttatacttcttttgtattaccacagcacttagcatggtccataaatgtttgaccggttaaccaaattgcattttggtgctttgatttgtggaatttcttgcttattggagactcaataatgtattttgtttctacttacgttgcagaaatttctaaaatgtattagaccattttcatgccttgataaaatacaatagaatctttgatgattaaaggccatagctatttttcaaacagtgaatacttattataaatcactgtaggtgtaggagacagggatgagtctgtctccaagacaaaatttaaagtgatatgagtttatttttgtgtcctttagtttattttcataaatattcaatgtcctatagagggatgaaccctgattaatgtatatttgtggttattatatgttaaagtgtttgaacattaagtttgaagggaccttacaaatcatctagtcaagtctcttccttttatagataaaggcactaaggcccagagagaagtgacttgtgcaaggtttcacagtgagttgttgccacagtcagggctttgtagcacactcttctgacgtccagtatgtgctttttttctcctgataataaaagtaatataactttatttaaagaaagtcacaaagaagaaaataccacccagaaataaatacttaatatttggtatgcttccttctaagattttttaaaatacggattttcccccaatgttctttttactgtgaaagttttggaatattttgtcttctgatgataggtcaagtcagctaaaatttgtttgcagaattgaataaaataatgtgcttatacgtctatatgaaacattattttgctttcaaagagtatttgttaaacatcttacagaatgcaattacatcttttcttatagtttccaagcctgcaaatgagaaggaagcagaatcagcaaaacacagccctgaaaaaggtactatgatctaggagttatcatttaatttatttagttatttttatgtaaataaggatagctacaaagggggaaaaggtggattccttttaaaggctattgatgtctcagaaattatagaaaatatgatagtaaatgacccatattcatttaattttattatttttaaaagatttgtttttaattacaaaagtaatagataattcttagaaaagaaattcagacagtacataagtccttttgtcttcactcaaccctacccgaaaacatttttgtctatatccttttcagatctattcctatgtatacacaatatatgcagacatctctcttttttaaaaaaatattccataagtactgttttataatttcctttttggattttgcagtatatcatggacatcttttaatgtcagtacatttgtatcttaaactctttgaatgaataagtagtgtttcaaatttttgaaaaagagctactaaagaccactttgttttgtttgttttgagatggagtcttgctctgtcgcccaggctggagtgcagtggcatgatctcagctcactgcaacctctgcctcctggattcaagccattctcctgcctcagcatcccgagtagctgggactacaggcgcccaccaccacacccggctaattttcatatttttagtagagacagggtttcaccatgttggccaggctgatctcgaactcctggcctcaggtgatctgcccacctcggcctcccaaagccctgggattacaggcgtgagccaccgtgcccagcccactttggaacaatatatgcatattaagaacataatatagaagctgttttaaacttaatagtatacatgagaatgactacataaaatttgcattattaagtcggggtgtattgttttaatctaaatatgtcctttctccctctctcgccacatattccctagttcccaactttcctaaagtaaacgttttagtctaaacagaaatgggaaaagtattctgagagccagtgggtgaaatgaaaggtaatttcagatcatttcctggattaaaaaaatgggatcttatatctcagtgaaataccttttaatcataattattatttttgaattttgggaaagtatagtgggctgttccttatgaaatggttttactccctttcttcaggcaaagggaaaattgatattcaagcatatctaagtcaatggcaagatgagcttttcaaaaaagaagaaaacattaaggatttaccaagaatgaatcaggtatagcatttttaaaaagaaaattctaagttcttgcttttttgtatggatgtgggtgtaacctctaaaatagctaacatgctattcccaaaatagttaaataatctatctattagctctctaagtttcagatgagcatggaagagtgggaagaaattttttaatgatttttttatttttaacactcaaatgtgtccagtgtttcagagaattcttctgctgtgacatgtacctatagaaaaaaagtatgtgtagtatatttccaactttattggaaatgttcatttattcagtaaacatttgtttactgtataccagataccaaacccaatgctaggtactgggaatgataaattactgagatgggtcacaccctggttcctactgatcttatatctgaacataattttaagttcatctctttcttatacactgcctaatcaaaatatgttcttctttttgtaattaaaatctggttagtacagatactgaggatcccgagaactttaccaaaatgaaaactatcaaataacttcatatttctcagtggactatatcatttgacaattgaataagtactttctaaaatgagtcagtatgacatatttattctagaattactataaatgaacagtactattgtttagggaaaaattctctcaaactgccttttttcctctactctcacaccatgacaataacaatcatcaacatagaagaaaatgtctgtggccaaatgtgtgggggttttccccccaaccaagcagcagataccagctgagtgtcctccaattaaattccaacactatctacctagaaatagtatgagatcccacaggttgagtgttcagtccccaagactgctccctcctttcccccagtaacaagtctgagcctcctgaacttctggctgaccaacttcaagttggggttcccactatcccttctttgagttcgattaatttgctacagagagacttacagaactcagagaaatagttatatttactggtttactaagaaggatattttaaagaatacaaataaacagccagaagaagagatacacagggcgaggtctggaagggtcccaagcgcaggagcttctctccacgtggagttggggtgcaccaccctcccggcatgaggatgagttcttctttaccttcctcctgtcagcctccatgcattcagctatcagaagctccctgaacccagttatcttgggtttttatggaagcttcatgatgtcagcattccttcccctaagggtatgaggtaagaccctttctagggagggttttaagaccgactatcagaaagctactctggaggatgaggcaggagaatcacttgaacctgggaggtggtggttgcagtgagccgagactgcaccattgcactccagcctgggcgagctgagatttaaccattgcactccaacctgggtgagctgagatttcaccactgcactcaagcctgggtgacaagagcgaaactctgtcaaaaagaaagaaggaaggggaggggagggggagggggaaggaaggggaaggggagggaaaggggagagaagggaagggaagaaaagactgtaacaaaggactatgggagttgtgaactaggaacccagaaaaatatttatatatatatatatatatatatatatatatatggaattcaggattaaacatcttaaacaattcttaaacaaaagcctatgattctaatgtcagtgacttttcattccatggaagcaggtcaaagtgcagcctaatttatgcataattttaactatatttctgtccagaattcttgttcaccctctgaggacagcttcaaagggactttgcctaattagaagtaccacctggccaggcgcagtggctcatgcctgtaatctgagtgctttgggaggccaaagtaggagaggagcacttgaggctaggagtttgagatcagcccaggcaacatagtaagatcctgtctctacaaaaaatgtgaaaattagccaggcatggtggcatgtgcctatagtcctagctacttgggaagctgaggtgtgaggatcacttgagcccagcagttggaagctgcagtgagctatgattgcaccatggtactcaagcctggacaacacagcaaggccttgtctaaggaaaaaaaaatagcacctaacatttaagtaatgctggcaggcaaacagtccaggaattagtctggataaaatgtactattaggcaataagtgagagcacttaaatgaaattttcttccatggttcatactcatctttttttttaagatggagtttctctcttgttgcccaggctggagtgcaatggcacgatctcggctcactgcaacctctgcctccatggttcaggcgattctcctgcctcagcctcccaagtagctgggattacaggtgcctgccaccacgcccagctaattttttgtatttttagtagaggtttcaccacgttggccaggctggtctcgaactcctgaccccagatgatccacccgcctcggcctcccaaagtgctgggattacaggcatgtgccaccgcgcctggcccatactcacctttctagaaccaatatgtattttggggttaatcaccagttcttataacttctagggtgaagcttctatggtacaaatcctatataggagactattcacttctaagttctctttatatttgctaagtctaatattcaaacgtgatattttcaacttgtgtcttctagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatccca

SEQ ID NO: 901 - DNA, 10983 bp, mus musculus; identical to SEQ ID NO: 127

SEQ ID NO: 902 - DNA, 10983 bp, mus musculus; identical to SEQ ID NO: 127

SEQ ID NO: 903 - DNA, 3295 bp, mus musculus; identical to SEQ ID NO: 129

SEQ ID NO: 904 - DNA, 39631 bp, mus musculus
acctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaa

SEQ ID NO: 905 - DNA, 156137 bp, mus musculus
gtaatgaaatgatatgattggaagtaacaggagactcagcaatggcctctctgagaatggacaattgaactgagacctgagtgatgaaaagaggccaggatttttaaaaaatatctaggagaagaacattgcagaaaaaagtaacagcgagggcagaggccctgaggcaggaacaggcttgatgtttttaatgaacagaatgaacgccctcctgtgtgactgaagcagagtgagccagagagaaaggagatgaggttggtgaggatcagcacatggcaggtcatgtgggggccttgcagaaattcagctagcaatcatcacgatcaatcagaggagaggcaaaaatgaagttagagagcttggggggtactgtaaaataccaactgaggaatttggatctgactaactgggcatgggagtgccactgtaaggtgtgaattgtgtgctgaaatggagtttgaggagaacaattccgagagcagagtacaaggtagccattttcatttgtcactacatatctagcacttgaatttcactcaagttatctgctacagctacttctttaccaatgagtgcaaatccataagtcactggacacctgttttcacaggaatatgtctagagtctatttccagcccccaagtaaagatattctgttgtatattgtgcctggaatttctaccagtgaggaggtgtctaaagcaaagttcccaaaccggctatttatttgataaggtatagacctgaactaaaaggatgctagcttaagtttagtttttatttcatttgactactgacaacatcagataagatcattaagccgcaatagatttacttggtaaagaagctaagagttaggtctgctgggacaacattgcttcttggttcacatggtttattaactttttcctttttttaatagggagagaagtcttatggaaagccatgtgggggccaggactgcagtgggagctgtcagtgttttcctgagaaaggagcgagagtaagttgcttatttcattgttgaaagacaaatagtggcatgggagctgttatctgttttctttagaaataaactgcttagaatttactcttatgacctcatggaacaagcaaagtgatgaggaccagctggaaggagctttgctaactaatgatagtcagagttagattggtcaaactctctgaggtaccaagaagaggtttccttcattcacttaatgccaaggtttcctcagagtttcatctggagtttttccaaaagccaattaggttgtagagagccagattgtgacaatgtttgtagataagtgtacattttcatagctcacttgattcttccctcccagtctggggaacaggtgttccaattgttatctacagactgtggatgtgacttgtccaaaatcaccctgcttgttagtgatagactcaagagaacaaggtagccataaagtccagaaatataggtgacgatacataaagaatggtttataggtattaaattacaacataggatacgttttaaagtgttgtgacacagtccgtgtattgtccctcattagcaatgcacagttcaaattgttgtgcaaattgcaatgaactcagtcattgacacaacatttctatcaatccctgaatatgcatagcccctagatatttgtatctatgattttcactgaaataaatgcatttttattataacccaggaaaagtgttgaaaggggttcaatctgaaaaaaaaattagacacatacacaagttgagcatccctaattcaaaaatctgaaatctgaaatgtttcaaaacccaacatttcctgagtactgatgtgacactcagaggagatgctcattggagcattttggattttggatttttggactagggatgatccatctgtgtgtgtgtgtgtgtgtgtgtgtgtgtgtgtgtgtgtgtgtgtgtgtttccaggattaatggccatcctacagagttcagaacttcccatttctagcattgtgaatacactctcatcacactcaaagaagactaagggcttatactgtcaaaataaagtagtactataaataggtcaaccaaactttcaaacccatagccaaacagggaacacagtgaccgttccaccttctctttcattatcttacatttggggtaaagtaaaatgtcaaactatgccagaatttgaaggaagagaataaaaatccatcttctcatcaaaggggactagatctattctacattaaagacatggacttagagaatcgtaaaatatgagaaagggaaggtatcttagtaagcttcacatcttatttgttgattgtacagaggaaacagacgcagaagaaaaattacttcctgggatcacatagcaaagtgatgacagattccaggcctttatctgggtcctttgatttctcatctatttacgtcaccagcttatctactgctgcctctcacggaagacatgttcactgtagccaccaagacccatgccctcacctctgaaacattctagaaaaaaaatttcacaataaatatatgaacacattcttgaataacatgcaagcagtatagacaaagcaaaaatctctcttggtgctctttcagtgccattattgtctttcttatctttttccatacataatcagagatatgtacacgtatgtctaaaaatagtctcattatctgattttcttttccaaaatagaattctaagtatatattctgggccccttttgtaaacttaacgtgtccttaagatctttttctctaccccatagtttaattcagccacccttttgacagctacttaggttgtttctaaatttttgctatttgtaaaatggcagagctacagtgaaaatcttagagtaggcctccttgtgttcaagcatagatactagctcaagcatagatacatctctagcatagatactaaggatcataattacctggtagaagggtaatagacatttttaaccttcaaagccattgacaaattaggctacaaagtattctccaatttatattcccatcagcattgcacaaaaatgcccatctttctacacccttgccaacacttgatatttttgctaatatgatgagtgaaaatcattctaattccctgagtttaaatgtcttttcacatattacctggaaattcatatttcttctgtgaatttcctggacatattctttagccactttcctaactgatgattcttattgacttactttacctctgcaaagatacagcaaataaaaatgacccaaatcgatgcaagtgagatttgaggtttgacacaaaggacatttcctgatggattgtggcagggtgagaagcagttagacacaacaaccaggaaactgagaagctctgggctgtttgttgggttggggagcctttaaaagtagaaaatcttatatatctgatcggaggtcagtcctacaccaggcaaacatgcctacagtgatctcattgttaagcccctggctaagattttgatctctggaaatggagggcagtagatttatttcatgaggagccctcatttaggtttcaaacatctggagccttagtctggcttctcttttgaaaacatctgagtggctgaggggatggaggatggaggaaattagaatatccctgcacagatttttacctcaatatttaaaagacacagactccacactgtcaaatatgttcctaaaaatgtatttgcaaagtctaaagtttcaaagaatgtttgtcaaagttactgaaccagaccaagccatatttcatgagtcaagagcaggaatgtcctatttcccaaatagataagaccgatgctcatgcagaaaactgaacgtggatgcttgaagcaccaccaggtcctgtttagtcatcctccctttcctcctaccttcccagggccaagcagaattgtttaaattggccccagcactattgaccctgcaggacagcctctcagtaccccttgtgtgcagatgtcagaaagatttgggactgttctccttagctgagcagagggcaccatttatatttcaagctgttcctcttgagctgggagggcaacggaacattgggtcaccctgagatgtgctgcagcccttggcaggcctgccccctgccttggggaaacatcaagcgcatagcttgctgggcagtgtgtacttttcctttgccaaagtcctcttgaactgactaggacatttacacaacacctagcactcctgcaaaactgcaatccaaccctttttggatgaagctatctcaaacagatttctcaaaggtatgccctgcctggtaaaagtccctacctaatgttggtgcactgctttgcagtttccaaaacatcttctttcaggggctgtaatcctgtatgtatgcaacaaataaagaaactggtaagtgacttgcgcaaggtcaccagcctgctagtagctaaaccttatttagccaactttaagagaatggcaatctttaaaaatgacctgcctcatagtgttaaataaacactatgttcagatttgaacttaatatatgactttcacttttctttcttaggagttaggtgttattatctggaagaactattctttcgggttgttctcttccctggtattttttttcccctgccacttgatcaaacaaaacattttaggttgacatttccaacacttctctttttttccctactagatctgaaagctatctctgcattatactccatcagtgtgtgtttgtctgaagttggggttgggaggagggggcagtttgttttcttctgagcctagtattccttaatactcttttagagttttccctgttgtaacattgttctggtgtttatctaaaacatggtgaccccctaattatccatgccatctaaagaagcattatcacagataatccaaaaccatggggaatgcttggattgccctctaggtaaaggctgtttgtcccccattttatgacttgggactttatgcctagcttgagagtttatgaagttagcctgagtttcatgagaaactgagcccaagtttcttaattccttatatcctgcctacatcctgctgttccactgccgcaaaatgtgtttcccatgaattccagaacctagatgcattaacaactagcccttcaatttattctcctcctgcaaacatctggcattccctgtgtcagctgactggtgccatggctaccaagaagcctttccattttctccttaattaggaaattgcaatgtacatctttcctcctccctgtgtatcccctcatgtccctctcctgactacccactacaacacacaccaatgtctttgtcctctactgctccaacatgaaagctcatattttatatcacctccttgggtggccaggcctttctccagctgcctgcacttaagttttgtgccttatttcatgacaaatatttgccctctcactcctcagacatttgtgggctggccctattgctgacactaatcactactaacttacttgttgccaaatccaatggatatttttcattccttatcttccttgatggccctgctatataagacaccttcttctctcctgaaactttctgttcccttgaatgttatgctatcctttcctagttcttttcctactgtgattgggatcccccagcattctgtcctcatcccacttttcttctcagtgtaggcctctcccagggtggttttatatactgcagggatttcagccaccatccataaaatgataaatattaaatctctagctctagttcagatctttcttcttagtttctgattggcattgtcaatttcttgctggatatctctgcttagatttcactggcaccataaacatgtctatacagaactccattaccaacccccaccagatgtactccttcctaaattctatctatgtcttccccatcacaacaaatggcatcaacaagcactgagctgctcaagccagaaaactgggagtcatgcttgtcttctctttcctttccctactacctccaatccatcattaagtcctgtccatttgtcttctgaaattgaacttgaatacatacacttctctccatacccatttctccaatctaggctcatataatttcttgccagaattacctcaataacctcaagactgatctctcagcctctaatctcactctcccccatcaatttgccactgtcctgccataatctttccaaaacacaaatatgtatcatgaaactcttgcttaaagtccttcaatggctcccccatggacttcacaataaaatccgaactctagaaaacctataaagtcctttattacctggccctggactacctctccaatattatctctcattattaggaaccctcctcacttcagaaaacaaaacaagacaaatattttcaaaaaacatatgagttcactgaactatttatagtcctcagagctactgtgttgtttaatgtgttgcaggttttatacttgccaccccttctacatatactagtcttccactagctctgccctttctctgttgacttgcttctatttttccatcctttaaaactgagcacagatttcacctctttgggaagatttccatgatctgccaggctggggttgtctactcttaccatcatttctcttcacttgtctgctctccactatcttaagaacaattaaagggcagagacagtgttcttagactctgcagagtccgtaggcactacacactgtctcatgaaagactgaccaactgaccaagcaattttgcataggtgtggttctagccctactctccacatccaggattagctgttaggatgctgtgaagttgatgggaagtctcctgttgagggagtaatccctgctgctgaaagaaggcaaagagctggggcagtcattttcacatcttctttagctcctgttagctgcaaggaccacacatctgatttcgatggttttctctgggattctgctttccttaactcctctgagtttttgacctggcctcttcttttgcttgattgcttcttactctatacctaataatgcaagggacttggcaaaatgcttatcttttacttccaacaattcattctttctccaagatgagaacattaatgaataattgtgtcaaaggtaatccctaactttctttgtgacgttgtttccaccctcctctccaccaaacctttcattaaaaacctcttaaccttttgcaaagttgatggtcttgttcctcttccttgtgggaggggggaagtaacgtctgagcagagaagtagccactaggtggtagtaaaggacggggtagaaaatcaggggtctttgtatatttacatatggttctttcggttcaggataattaatgatagtgttaaaacatgtgtctctgcacagaatcaagatgcaatcatagccctgcagatgttcgtggttatcttaatcatttatttgattgtattgtgacattacaggatttatggaatatattatatgtactagtgagggaggcttctgctagagaagagccaaggagctggagaaggagatagataaatacacagctgtggagacaagaacactgctttaactatccagagacctaagtgtcatgcgtgagctttgccaactggatgactttggtttggtgctttcccctctcaaggtctcagttttcccataggtgggatgagagatttgggatgtgtgatctcaaaggacctgcaagctctgacaatctaagtcagacaccacattactgtaccctgatggttccttgcccctagagtgcattatcgtgctttctagtattgaagtgagatacggaaggtgatgtttgacaatgtcctatcctctgaatggtgtcttggcagctgcctcagatataactcatttgctgtggcttctttactgctgctgcttctagatgctcctgacagctgaaattgtgcttctgcaggaatgtgcaggactctccttccttggtcatctggatggtgtgatttgaagagtcacaggaatttctcttcaccaaaacccaacaaaatcttccctgccttgcctaggagtcattctgcttaccgttctagctttagaaactcgctctttaaatgaagcattgccctgtccttgcattgcttgtataaatctcatgtgcctctctgatgagaggagccatgctcactctgcatatctgtgtgcacaaatcacaaattttgggggaccactcagttttccttttgctgtccctgctaagtcatatgacagagacatcagatattaagacatgagtgagcatcttgcaggtcaacaagcgacatattatctcctcctagtctaccccctccttcagttgccagatgtgtgcccctttttgcttcttgttcttcctttcctccctagtctctaacttccccttttctccctcaagacttccttccctcttgctccatttctagctttccatccctcattcctggtttctccaccatggcctcctcctcacctagtttctcccctctgccttcagttgcctgggattgcttcctatgtcacttatctttgactccagtttctattttttgtcatttatcagcacacatgaaaactgcagcagcaggatagcagggaggagttgctgcaatgtactttatagaggcatcccacttatccaaagattcttaatctcagagcctgaataagtggtctgcaaattgggggggtggaggggggagggcatgcaggtcaatttgttgggtatagaagaaaatatgaaaatttctattcacatttaatttgagagacactagaaagaaattaagatttaggattaaataatttatataaagtgtttaaagctgtgtggttcactaaatgctatgtattagactattattattactattatatgtaacatgtgtattttcactggcatcctcatcaggtgagttggctttcttcggctttcctgttgtgcatactctgtaaggtatcctgagggaagagtgggggctccacaagatggaggggtgtccttggggcccttactttttttcctgaatgtataccagagatattgatgtttccttggacctagttaagtagatttatggatattatctaactacatttaaccctcacaaaatggacaagcagcttaagaagattcctgcaaatagaccatgtattggagataatactagtaatgtaagcacatggcagagctcacacttctactcctaaaatgagatttttatcagcctcattatgaagtaaaaaccatggtaatctaattacacctgacaagaagtcagcaaaaacatattgcaagaataatgaagactatatgaaatatggatttatgtcaattctcaatgatgaaagatcttgccctaagtatataattgtgccttaaggtattagctaataatataataaagccatcacaattaacaagacatttaacatgctgtttatttcatctttgtctcatccttttacactttttatttattgtgtgtttcattttatatatattatcattaatatatgggggagagattaggacatgtgtatgatttatataattgttaacaatgtataaatatacatgttttgaggaagcatgctcaaagcttttctaattgaaaaagggtgtgcaatcaaaaggatttggagaccactggcctaaaccatacttaaaatagctgggagcccgcagacagaggcaaaagaactctggataagagaaaaataactgtcacaaagtctcttgctctttccttatagcatagtcatgcaaccaactttagagcttcaccttgacaatttcacatagaataaagcaatggagatctcaggaactgggagaagtgaaacaccaaaggaacttataaaataataaaattgcaaggctggaaggttggatccagccctcaagaggtacatcgtaggttacaaaaggctttcctggcatgcctatgaatgctctttccctcactttaattatgaatgggcttggaagaaagtttcagagagattaagagactgtcccaagatctcttgtaagtgacataactgagatttaaatcaagtgttccattcccctccatagtgttctttccaccatgtcaaatggcctctgaaacctttgtggccataatcagctgagctccctgcattactcgttgcagtcagattgttgtgattggaggaatacttggagtggagaaaatctgctaggaagacatccacgagatatcaacaaatcaattgcccttcgtcctccaccctagtgagtagtaattcctgactgcatgtatagcatccatttatatccctgtctgggttttaaagtgtttttctaatatccttctcttttaaaggtttaagaaatgaattccaagcttaaggaaagcatgttttttatatgtgattacaagttctgtgaggagtcatgtcagttttcacagctgtaatgtgtgtctgtccctttatgtaggccactgactgtatgaaagttcactgcaatggagttagaaacatgtggagatgaaattaccaagtatatgtcagggaagtaatttggtgtctactttgagaagactcgcattaatggaagtcttccaagaatgtttaagaaaattaattgcacagcaactctctaagctatagtaaaagttgatggaaaaatgtgcattgctttgcagaaatttgcttcactatcatcttttcaaaagagcttttattttaacaaatgaagcacatagccaattatttaatgaccatctttacttttagaggtggaagtcctagactatgttctgtgttttcttttatctcattgtgttttgtgaggttcaagccccctagaaaaacatttaagaaagtactctgggggctaaatattggtgcaggcactgtggggaatggaaacatttcataagtaccagacttctacttagggcggctacacacacacacacacacacacacacacacgccaatgtttgactacccatcactgcatctgattaaaagtctaaatggtaaatcacgaaacctcaaatggatagactggtatggtctgtagtaattaagctatctctttttaaaaatattatgacaaaaaatatttctttaggaatattaatttggtgagggttatccagggtggattggagtaagagacatgataggcagacactaagctccctatttttagatgtaagtggcatgtccaagaccccctagcacaacagaatggaaactttgttttttctgctgcttagatgctttctttcagtggttttctctattcctgaatacacacacacacacacacacacacacacacacagagagagagagagagagacccaaactagtgatttgatgatgtgacctagtcttcactttagatgaatgtatgacattttaatttttaaaaaattagctggaaaatagttctagctcctttccctcacatttgtctaactctttggaaaccagtgtccccattggttagtccctactaattccacttaaggagaattcatcataaaatcaagtggaattggcatcactgagatgatcctgtcttgattccagaggtaggactattagatgcttttctctgtgggatgttaaaagctcctgtaattactatgatgcccagggagaaagaccaactcaaagggtcctgaaagagcatctgtttcctacctgacaaattttattgtgggggttataagtataaggcagagtttggggaatcatgaaagaaggaagtcattgtctcatataaaacagattttaaagcttggtcagcagaaaagtctgcagagtaccttagaattgtgcccttatcctgaattactggctgtgaccatggcaggctcctacggtggacttagctaagccctaggctttgctatgacagcctttacaccttttatcctcagccttataagctcagttttactttttaatttttgaagaccaaaagaaaaaatgctcatttctttagccccaagaaagattaatgtatgtttggttatcaaagaaattgtggtctctgtccttgtacatgtctttgctagttcaagtaattgtagtgactttgcattccattacttcagttaggttctctctcagagctgacacgagtcagtgattgctacccccttcacaagttgttgggggaatgccaatacagctatgagcaagggagggagctgtggaggaacatgctgtggggcccagagaggaataaggggtaaccagggttcaggagccaggtttccccagagagagacaaaaagaaagcaaacaaaaggaagagacaggtctaaacaggctccccagacagggcccctttgctttaagaacagagccttaaacttcacaaagctcagggaggaaaggaagccaggggttaaacgtggcctttgaaattcagttgaagaattattaactgaaaatatacagagagaaaagccacacatatacacagcaacatttgctattcttaaaacccattcagacactctatgaattcagaaatgtgcttaaacctgcatatccacatagatactaatattgacccctcaggaaccacaaaggtaccacaaagacacagataataaacataagaagaggctcaacagcaggaggacacagagtcccaagatgcctaacgtgggttgcttttggaggcatgtggcagacagtttagtgatctgatgcgatccattatcagaactggggtcccattgctcctgtaattggtaccagagtaagaaatttaaacttctccctgaattttactttttaaatcaagtccaaactgagccagagctctgagagcagaatagaagcccgtctctccctcttcctcctccttcataaaaggagcaaggagacttgaaggcctccaaggtcccttggaggcaccagagcctgcaatgtggcaagtccgcctgccccctccctgcatttacagtccaatgacccaacgcccccagaccccagacagtttaaccagcccccgcagggcctccttgagagtttcccagattcctgaggggaacctgatcccgccctgggatcagcatgggctcttcacagcatccccgaaagatccttgctcctcggggatccccgagaacagcacccgttcccacacacagccatccctgcagcgccatcacccacccgtggctgggaggtgacctcccagggtcagtggtgaggccgcccagggagagggcccggaggccaggcgggaaacagagcagaagcgacagaaattccccctgccagcccaggctgccaaggtagccctggacaatgccctgtctgacccgccgccccaccaagccaggccacggccagagccagagtggccttcggccctgagcgacaggagaaggcagttctgaagcaaacacggcacaaagacaaacgcagcctgggaactttgcaccagcttctacactggaaggcctaaaacgtcccttgttccaaacacccccctcattccccccaacaaaagtatttacctcatgaagaaagggagagcgctagactcacagaacagttggcagagccagaagggcaatcatctagtctgaccctttcatcttacatatggggaaacaggcccacagtaaagaagagacttaaactctgaagagtgtttttgaaaagtctttccttgattatgaaggcaagatgtgtgtgtgtgtgtgtgtggtgtgtgtactcacacacacacgtgagagagagaaaaagaggtgtggggacgagatgggatagaaaggagaagacaggagaggggagggaagggaagagaagcagaggggaggggagggactgcatgcaagcctgagccaaggaacttgtgagcaggaacactaattgcagtgcaaacaaaaatatctttgagtgtaagttgcccctcactctagagaccagattttcttcccacttcccaggggcccacagggacccagaacagggtagagaaatttgccatttggggaatacaagtaagggcagtggttgagagcatggattttggagtcagatagctaatcttttaagccctggttctatcatttactagatgtgtaaatgatacacatttacccattgattctcaaccatattgccccccagggaacatttggccatgtctgggaacatttttggttgccacaactggtggggtcatactggcatctagtgggtagaggacagggatgctactaaacatcctataatgcacaggacagcccctcacaacatagaattatccagcccaacatgtcagtagtgccaaggttaagaaactctgcattaggtgaatggtttagctattttctgaacttcaatttatttatctgtgacttgagaataatattacctatctttcagggttgttaagataattaaataggctaatacctttaaagcaattaacatagtgcctggcacaaagtaagcactccattaattattagatttgagtattatcaaaccctcccttaactccaccatctcctatagttaccatcctatttccctgttccccttatagcataatttcttgaaatatttgtttatactcaaaatttccactttcccaattctctcttgaacctattctaatcaggctttcgttgctaccactcctttcttataaaggtcacaagtgacaaacacattgttaattacaatggtaatctctcagtcctcatcttacttgacctaccatcagcatttaaaatgccttttcactctctcttttttgaaaaactttctttgcttgacttccaggatactattcctttgattattttcctaccttggtggacaaagcttcacatttcctttgttccaagagtagagggcttggtctgatttgttttgttgaatgaatgaatcaacaaataatatttactatgaagattaaaagagataattgtttaaagtgcttagcacacattaagtactcaatagtcatcaccaccatcactacgactgttagcattgatgttattgctattacaattattctcccctactgattatgagccccttgaaaatcagactaatggtactttgtcttggttctcctttgtatagagctttgttcaatagaacaatatatagccaatatccagaaaacagtttccaatgggcaggattagctgaagatggcgtgagaggagaaatattttataaagagttttactgaggttagaggtgggtggctagaggctcagaggaacagacatgcagtaggaggtcataccctacccattttcactctctgattcagaaatgataggaccacgaaagggaaggagtagcaattctcacccattaatcatcccaatacctccttgcctaggtatggaggagaagtgggcctgtggccaaatattagcatgaacagagcttatctgttgggtttgacagagtgaacaacataaattcacttttctcacagtactggattaacttaattttcagtcatcttgaactttgagtaactttatacactttcctgctcctaccaccatctttacaaatttgcaagtggcatttatattacccagagaatatggtcccttagggatagtcattagagaaagcacacaacccaaatctattagaaaacttttgaacactcaaagcatccattaggtgttgctgatcgttctgataacataatttggcagcattttcagttaaaatgaggtaataaccaaataggatctttgaaccaagtttcttttttccactaaaaacagaatgtctagatttttatataatattcaagccattaactaccaccaactgtggcattaaatggtggctagtctctcccttatccactttaccactcataccaagaaaacatccataatttggaccctgacttggaaacgtcattaaataaaacccatatgtttccaatccctgaccatccaaaaccccactcctactcacttgcattatcacccatatgcaataaccaacttgctttgcagatgggtcagcctatctgtaaattgccagataggacctgtccaagtgcagagaaaaagtttagtccgatttgcataagcaaccaaagaaaaatgtttgatccacaaaacccaaaccattaacctcaaaaggaattatgatgatacaactttattttcaaaacagcattttttcacttttttaaacaacagtcttattttttaagccttccagtaggtgcttaataaatatgcaagtgacataaaggccaccatgattttccaattggcttggctattggtggctttggcagttctactattatttgtcaaagatccttcagtatccatctgggcccacagaaagccagagctcccgaaagaagtgttgatagagcccaagggggaagttgcaattcattctggaaaggtgacccagctgccagcatcccctgagcctcctgtagatgccaaatgagctccttgtctagtaatcccatctgtgatctaaatgtatacagaaactgcccgatcatctcctcctcttgactaatgtgcacatggagatgtatttgtcctactaagatacagagattgctgtcagatctattaaagataacagttgtcatctttttaatcatcattattgtaaaaatgataaggataacacataataatgagatagtaatagctgttgctatctgtatttactctatgtcaggcattgtgctaggtattctatatatgtctcatttaattttttaaatgagatataaatatcataccataaagctcaccccttgaatgtgtagaattcagtgctttttagtatattcacaaggttctgcaaccatcaccactatctaattccagaacatttcattaccttgtctcgtttaattttcacagtagccctggggaataaatatttattttaaaccccattttgcagatgaggtaacatttacagaggttaaatgatttgcaaagctcccatagcacataagtggtggaattcagagtcaaagacagatctctctggaccccaaaccgaagcgtctctttctacctccctgatggttctttatttgtgccatggtctattttcattttcattcataggaacaccaaagggaacaattgtaaccttcttgttttgctcttctacttcttccccttttctcctttgttccttaaggaattgatggctttggtgtccctagcaactgccatcctcctgcctacctacaccacatacacacacacacacacaccaaaaaaaaaaaaaacacaattgccctaacaaaatttattctcagctagtgacattagtttgcaatgaagatcttaaacacttataaaaccttaatttgttaccctttgttagacctacttttgtttaatagaaagtcattatttagcatagtgataagaaaagaacttaggtaccaagcttggattttacgtttggtctggtttccccatactaaacatgttaccctgggcagttgacccctgtaagcctcagtttcctcagctgaaaatgaaaatagtaatcctatgtacatcacagggctgctatgagggctaaattgaatatacatgctaaatgtttgatgcaatgtcttgaaacagagtacatgctcaataaatgctggtagttattttggtagcatcagtgagtggatagaatgtggaattatagagtacttgtcaagttatatggcctagaatcaacctaggcagcctgcccacaaggcgagttttgataaaaagcatttattaagcaaggaagtgcatgccaggtagtataccaattaagttaaatagctcctgcaaattcttgccagtttaatcaactaaaaacataaagataacttttggctttaaatcgctgactgctttcctcatggcagtcacaacattttcctctttaagaatctacaatgattcccaggtgtcatcaaaaaaaaaatcacttgacctgtagaatacctagtataacctggacttgtacagtgtcaggttgggtataacctgcctgagtaaaccaagtagcctcagcagacctgtatggttgggtagaatccgaagtcccaaatatagttcagattataacccatgggctattttagagttagcaggttgggatgagaatctggaatagatttcaagccaggttatcatttaaggttttaagtagcttccaaaatccattctaagcatgggcagggtgggcagttggcagaggtccaaataggctgcctgaacacaatgtaagagcaagtaccagagacccaaacttgactaataataatattaagtacttatcataggtgagacactttgctaagggctttattatgtattaattatctctttattcttacaacagttttgtgagaataagtggtatcatcctctccattttaaaaataaaggaaatcaaaggtcacataactggaaagttgtgaagctgagattcaatcccatatctgtctggttcaaatatgcataccctcaaccattatactgtaataatacctcccaaaacactaaagtactgctggcaaccaaaggcttggagacttgggcacaaggataaaatggtcccggcaataaagctggcttgctgttttgctagacaattattgaagtggaaatcatggctttttttttttttttttttttttttgcttttttccttctctttcctttcttttttttttttttttcctaagagacgggatctcactgtgtcatccaggctggagggtagtggcatcatcataactcactgcagcctcgaacacctgggctcatgaaatctttccacttctgcctccctagtagctgagacgacagtgcttttccttctactgtgtggtggcagcagtaagccaagaggctgagatgggggctgagactttcagggaggggctcagagaagccctgagttggattgaaacagattactgtggtgatttttcagggttttatttctcttgctgttgtacacaagttcactttgtcctatagatatgtccttggaattttgtcttgattgcttcacatattctaattttcattgttcacatatagaataatagcttctatcactctacctttaaagttcttatctccttcccttcatctagaagagaaaatgcaacaagcgggagaagatgaccctttcactcttaaagagcttcataaactcctaataaaggaaatgataacaatctttctaagaggcggccccattttgcaatgatgaagtctagatgctacagaaatagtcccagcaggaaatagctgaaggcggaaggcagtgttaaacagaaagcatgtgttgaaaaccaccttggtccctttggaagatgaaaatatgttgtaagctactgctgaatgttttctcccctctagtggtcagtggaaggaggagacaatggtggtataagtggtgcctactttttaactgtaaatgcaatattacaagtgatattcgaagaaaattgcttccataagaacaatgctataaatggaattatgtttcagaccaaggatactgtatcaaaaaaattaaaaatatgaccaacagtttgtgatactaacaaaggtacaattacagtaggagtataataattctacataaaaaattaagttgtatgccttatattgggcatagatatattctatacagtgattaaaaagaggcctctgctatatcatgtttgtcatctaaatctaaaatgccacctacaataaacaatacaatacacattgactaagcatttcattaacaattttgtttgccttcttagattttaactttaaagtgctctccaaggtaatctaagttctcaccacagaaccatttataaaaagaagctccacattcacccagatattgtttaaagcgtttccaaatgtgtctctaaaattaatactggcaatttcccgtctcagctaatcctctctgcatttttggcattttgtatcaataacattaaaaatgttcacagtctttaacccaggaattctactcttatgaatttaattgaaggaaatacaggagtaagaaagatttataagtgaagatactaatcagagccctatttgtaacagtaaaaaaaaaaatagaaaaagcctatatgtcttacaataggagaatggttacttaaagaagtatggtatatcccttacagtggaatatcatatggtcacataaagtaatgtttcttggaagaatgtttaatacttgtaaaaatgcttatggcataatgttaagtgagaattatggaaaacaagtatttatacaatatgatcacaattttgtaatgataattattctacacccaatttttaaaaaaggttgaaatgacatgcactaaaatgttgtcagtgcttatcaccagcagagaggattatggggaaattgttggacatgcagagaaagagaagaccacaaaagagactgagaaagtatcagtaaataaggtcctaatgagagctgaggaaatgaggtgactggagctagataatggagctgggtaggtcctcttggacagaagcctaggttgattctgtgaatgagagggcagacccaactagagtgactagccaccctggtttgcacaggactgagggctttcccaagacatgggacttaatgtgctaacactggaaatgtcctaggcaaactggaatgaattggtcaccccagactcaagacgtatctgatttggaaggccctatgtgatctccaaattcaacctctttctttttcagattaaaaagcacccaggaactgggagatgggtagtgtcatgaccaaagtcacacaggtagcagagcacaggactgagagttcaaaggatttagctctgctctctgctgtgctgcttattaacaagacatttaatctgaggtttaggttaaggacataacaccttgcgtgttcaccagattatgacaaagaccaaatttaattattcacaaatacaaggagttaccagtaacaataaacaagtattaagcacatactacattgctttgggctcaattctaagatcaaggaagtattaataattccaaatttatagaattatggtaaagtctaattgagattatatttctaagcaaattagtacaatgtttgccttctacaaaggactcattaaacgttagctctgatgattatatgtcacattttaatacatagatgtggaaatcccacaccacttaatagtaactgtgagacaggtacttttattaatgatcccattttagagacaagaaaattgtggcccagagaggttatttgccttgcttaattttatacagtcagcaagtgacaaggccatttgtctcctggtcaagccctcttttctacttcattaaattccactcagtagaaagcctttttggatgagagcacagtgaacactttttctttttacagtaaacttccttcttcctacttacatcttcagtttaatgaaagcctcctcttggactaaatagaggccaccagggagccttccatgagatattttgttagcaatcttctgagaatttcaagatcctttagaaacattgtaaaacaattatagagtctgcagaatatcgcttacagggtaaggattaaagttagggatgctctggtaaatgtttaaccactggctctgggagagggtgagagggggacactgattagtaacatttgcagatatccatggtgtaagtatttccagcatggctgatttcaaactactgacgagattcgctcctgcaaaccagtgccagccaatgcaggccagtgcaagccagttccagcacaccactggaagcagaattccatgaggccattgctatccttagtttatataaattcaataagaattaaagtgtgagcgttattcagggagcttggttttaatatatgcaaaagggagagagaagtgagtgcaggccaatgggctgggatattgcagagagtaggacaacttaagggaatgcccagaggaatggaggttgctgcctgcaagtctatgtctggcccttcttgaaaccttttaggaacaccaaagcttgcacctacaataattagagaagtttttttttaaaacgaaaacaaaaacaaaaacaaaaacttggcacaagccttttgttttcctgccaactttttaatttgaacattttcaaaccttcagaaaagttgcaagaatagtacaaagaacacccatatacctttcacctagattcaccaattgttaatatttttccacacttgctccatctctttatttctacaaactatttgagagtgagttgcagatatttgaattttcacccctaaatacttaagcatgaatctcctaagaacaaagacactctgatacacacacacacacacacacacacacacacacacacacacacactatactcattgctcttgggaaatataacattgataaaatatacaggtttagagtctgtagtcaaacttccccgttatcccaatgatgtccttataattttgttttttcaatgcagaatccaatcaaagattatgctttgcatttagctgacagcctctttgatctccattaatctagaacaattccccagacccccacttttattcttttgtcttttatgatgctgatatttgttaagagtccaggccagttgttttgcagaatatctctcagttagatttgtctgattatttctcatgaatacattgcagttaaaccttttagtttactaccatgttatgtccttctcagtgtctcacatcaggaggaacatgatgtcatttttccaattattggtaatgttaaacataatcatttggttagggtggcgcccaatatatttctccattgcaatgataccagtaaagcttatcatttgtgtgaatattcagttccaggagaagcttctttacactgaaagtataaattacttggttcactgcagaaccatgggttgaaaaggcattatccctaattaaatgaaaaaaaaaagagatttatttaaaaataagctggcactaagcttcttagccaaattcatgaactattcacatgacaagggaccttatctaaataaggagttccatatctaaattgtgaactcctggtagagtattatgccccagtctatacacgcctttatgtctagaacttagcctagtgcctaggctatagtatatgctcagaaaaaggttattgaataaatttctgtccaattggaattactgtctccatgaatgagaaattaatcatactaaacaaaaaaaatgtactttttttgtcaactggcaccagctggaattgatttggctgcttaagtactatgtttctcatgggaaatgacagagcttttcgttttcatccaggtatttgaccttacttaggcactattcaagcctttggctgctctaaaaatcttagcttttctatatcaaaattagaagctgttctaaataaattaaagatcaaccctgtgcttgttaagattatatttggctacaaatgacagaaaacccaaaataacagttaattaaacaatacagtcatttatttctctctgatataaaagttcccacttttggccaagatggagcaacaggggctggacttaccctcatgcctaaaacaagtgaaaaaccagacaaaaggaaaacaatggttttcagacattggataccaggccacaaggaacagtgattcctgagagacaggaaactaacaaggtgagccctatgatgaccccagcttattacctggacagagtttcccggcagtggtacaaggacagggaactgaggcaaagcccagtagatgaggagatgcagctgggaatccagggagacctagacaggtagaatttgcagaacaagtattagagaagagagagctgcatgaaaagagaactccggagatatttggagtcctccttgaatcttcggttgagcactgagcaacacatgtgtgtaaggaaactaacctagactggggaaagaactacccaaaaggagcagaaggaacaatcctcagagatcatatagggctgtaaatagtgcctgccccaccagccagaatagaaaactttataactcacatagcatcagagtactaaaaggatcatgcctcagtagcagtgccaaattagccctaaactcaaggctgctctagagctgccaaataaagttttaaaacaagccttgaaagaatctgtttccaagtaagttaactgtgtcacagagcaaagccaaggagtatttacagaaacacaaaatatccagcacccaaccagataaaattcacatctgacttacaaacaaaaacgaccaggcatcaaaaagagcagggaaataggactcctaatgagaaaagtcaaccaaccaaaactgacccagaaataacacagattataggattacaagacaaagacgtttaaacagttattataacttttggtgtttttaagaacctagatgaaaaattgagtatattaagtcaagacatgaaagacccgaatagaacttctagagtagaaaaattcaatgttgagatgatgtaagagtccatgtaggtagttgtgggcttgaatggcatctccatgatcatcagggacccagactacttctatcttctttctccactattctcaacatatgatttccaattcagggtccaaaatggctgctctagcttgagccatcatatcttccttccaacagcaccatgagagactaggggaaaggagtatgcccctccatttaaagatgcttagaaatctcagccagacatgatcgctcacaccttaatcccagtgttttgggagacctggatgggaagatcacttgagcccaggagttcaagaccagcctgggcaacatagtgagactttgtctctacaaaaattttaaaaattagccaggtgtggtgatgtgcacctgtagtcccagattcttgggaggctgaggctggaggatcacttgagcccaggagctcagggctgcagtgcactatgattgtgtcactgcaccacagcctgagtgacagactgagactctgtctctaaaaaaagaaatatctcatgacatcccttttgcttacatcccatggttcagaacttagtcccagggtcacagtcacctaaaagtgagatcaagaattgtagtctttattctgggtggctatgtgcctagctaaaatgtcagagttatatcatttaatgaagaatgggaaaactgaaataggggaacagctagccatcacatctcaagttcagagcctgctcatagtgcagaagaggtcctgatccagtttgaatagcattatgatccctggcttaaaaataacttgaataagactgcccctcggtgtttttgttacctagaaattaaaaacttgtttgtggttgtttaaattccagcccccacacttctatatactttcgggtttatctcaaacaaactgccagagttgcttcattttccaaatcagtgacaccaagctagaggtggagcttaacattttgtttgacttatgcacatgtttatcattgccaagaaaccagggtcacccagcctatttataccctactcctgaaagagctcactttctttctttcctaataaagtcactaacacctgcagctgaaacaaacattcacaggagcatccacactgcattctttagaacaccagatccttcttcctgatggagaaaaaattggctcataatagatacaacccttttctatgggaccacctcactcctacccagaatttcttttggttagccatacagctattcctcaatcttgaatcacctggctgttacaacttattggtcctttttaacagcttttcagtgtttctgggtatattattgctctcataatgccaaagtggatgccattcttctcaagagatggtaggtgggcatacagttgatctgtttttatcaggcaagactgtattgctgaaaaatggcagtttttgcaaggtgccatacaaaccaagtgtcatggctggctcactgagtgttcctgcagagcattttgcactagctctgtgtgctgtcttgagcaactcagacccaaaaaaaatctgcaggaagtcaggcctgggtgctttccagttgctgatggctttgattgctttaacaaccctccgctcagacattgccatgtgacatttccactttaccccgataaaagctttctcatcctgtaatcacactgcttctctatgattagcatcacaactatcattattctttacaccaggtaatggtgaattgtgaagtataacattcacaggggttttagtatagccaactaacaatctagagaaatacttgggtggaagagattgggatagaacttccagtgctgatttggactccagattgtgacttcagaggaagattctttcctcttgggctctcctactgtgaacctgtccacagaggcatgatagaatatgcccaataaacacactcactgacctgctgtgccctatctgatttgatttcccactgggcacccagtagacccagagtatacagcctgggccgcttgggaaagaacaggtggtttttgacttgacaaaatgctgtttgtcaggtacaatttcgttttcagtaagaccttgctgtttggataaaaggaaggataggggtagaaagttgaggtaaagggaagataacctgtgggattggccaggtgtttctataaagaggaaatggacactgagaggctaagttattttccaggtgaaagtaagaagtaaacctttgttagacatggaggcacgtttgaagcttgatgctttatgaactcgaaaaactaaaactcggttccatttattttaagtaatccttctttaatcatgactatcaaaagattggtgtaaaagcttgaactgccaatgactattaatactgtaaattgcaaacatttgctagctgaatgcctgtctttctgaccacttttttattgattgggaaagcataacattctttaaactggtttgctacagatctgtaaagtgtctggatccaaatagtgattttctccagttgaggcaaatcaaagagttttttggtagtttgttttgttttgttttattttgtttctgtatgttgtcacctgtattcatgctttactatattggatcatgtctttttctttttctttttcattatactttaagttctggaatacatgtgcagaacatgcaggtttgttacataggtatacatgtgccatggtggtttgctgcacccatcagcacatcatctacattaggtatttctcctaatgctatccctcccccagccccccagcccccgacaggccccagtgtgtgatgttcccctccctgtgtccacggttctcattgttcaactcccacttaagagtgagaacatgcagtgtcagttgtctttaagtaaaaaacttgagagtttcacccaattatataaaaaagaataattcagctttttaggttttgtatctttcttttcagtgggttaaacctaaagcacaagagctgtctgtcttctgccagtcaggcagagcaatggagtagtattagcaaatcaataaatataacactaaacctactgaatgtattacagttatttctgcctctgtattttgggcttcatcatcttgctcacatttctcaagtgtgacccttcttcagatgttgtcctctatcaccagagcatcttttcaaacagcaaattagtatccatcaatcttcctcccccacagcccaccttttattaaagaggctctaccttcctcccaagccctctttttttcttggaagaccattttttcttggaagaccatgtctaatacattcttgtcactttgtatgcctttgtcatggtagattttaaaggctttcttaagtgctccagctgtaaagcactgtgtcctgctgttctctgtaatcaaggatgtcagatctcacatgatcagctttaggtactgaagagaatagaaagatagtctttgagactcattccactccccgcatccccgccgccaacccccccccaaaaaaaaaacttagggggatcaccctctggccaaaggagaatgttcatcttaaggtacagatgctctaaggcaaacattatttgaactgacaggaacatagcaagtacttactgaacacttagaagtgtacagaattgagctaggtacaggagcggaaatacaagactggcatggtatggttgtcgccttgaaagatgttctatttccagcttagggaagagagaaataaactgcaaaactgtaagagtaaacagtccatcttataaaccatcaaatgttagagttggaaaggacctttagttatcatctagccaaactgtgttttcaaactgtggatcaccaagccctaagattcagcagagtgcctcaaaggctgactatctgcccttcttgcctctatacctttcttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgacccgattttccaggtgccgtctgtcacccctttctttggctaggaaagggaactccctgaccccttacgcttcccgagtgaggcaatgcctcgccctgcttcggcttgtgcacccactgtcctgcgcccactgtctggcactccctagtgagatgaacctggtacctcagatggaaatgcagaaatcacccgtcttctgcatcgctcacgctgggagctgtagaccagagctgttcctattcggccatcttcgcctctatacctttcaaccagtggtacttctttgaaattctctaagattttgtttggacaaaggttccattgctttcgaaaatttccatgttattaatctagtccagctttctcatgatacagatgaagaaacagagccccagaaagtaagggaatgtttgaggtacatagccaattaaaggttgaaatcctcagtatcctgattctagtgatccacttccccatgccacctagcagccaagcagcaaacacctttaaaatggcagagtggcttgctgccttaggaagagccacctgccttaggagcaggaagaagttgcctttggttatcctgagccaggtgctcaggtctgcattactctaggaggtcaaaaaaaggagagatcagtaagggatgtagtttagccttccattttgctgccctcaaatgtcctcatctttcacaggggataagagtacctagctggtagagttgttgtgaggattaatctagatcacacatgcaaagtatctgggacatagtaggtgctaaataaatggtagaacttaatactataactatttctttggaacataaagtgcctatcttctagctttgtggctcccaattattctataagcaaagacaatgagaatctgtgaatcagaatccaggtccaaagtttacctggtttaccagctaaatgtcaatttcatgtcagttggtgggatcaaggaacagccttaacttgccagagagcttggcatgctttggcaaggtctgtgccctactctgccagaacaaagtgctaaaaagaagatgtggtattagggcttgtttaagacataggtctggaaaatacaattctttgctttgcctctcataatctgactggcataaatgagggagataattgtcataagggatggttgtttttcttggataaattccattcttgagaaatcacgaatgaaatttcctcacttggaactaacatttgtatacattgctacaaagagatctaaacaggaggaaccttctgttttagagaaatggcctggaagacatcatggatggcattgcctgctttcatagagtatgtgcttcctgtttagtgtctgtgactttggctggggaattttccaaggcaaaggttacattttgggcttgaacttcaaagctctactcatgtgcacccgtatgccaatctcagtcccacacgattgatttcctcctgaaggcatatgtgctttcatttgggtttcggccttggagacttcaattccagtgtttgtactctgctaattcccccttagattatacattgcatcccctcttctttcaattgctttatctcctttgagcagtgatcctgatttattaaaggttaaacagtttaccccaattgcccagttagaatgtggcaagagccaagaatagaaactaggtaatatgactctagaatttgggagcttaacctctatactctattgctcagggatttcaaaagcaagaggaaacacctcatggctggtggaatcaagaattaactcatacaggatagagcaatgggctttgtgggatgcataggattttaacagaaacgaagcagtggagtaatttgagtgtgccatacagataggaaaacacaggataaatatgggccagggtacttggcttgtcttgaatataggattgcttgaaggaggtattggtagataattccttgaacatagttgaaagtatcttatggagaaactgttttgatagaatgaactatgcttagttttggaagcaatagaaggttcttcctttcttccttatttaccttttcttcccttccttcatttccatttttcttcctttcctcccaagtaatacaagtgctttatagaataaaaactataaaatttcaaaatagaataccacttgaaagcagggatgattagtgttaacatcctaatgtatatacccctagatttctttcttattaaaatatattaatataaaataattctgtgctatggaagacaagattctaagactcccacccccgcctatatgacctgtataattccctcctcttgagtgtgggtgggacctgtgaatatgatgggatattgctctcctgattaagttatgttacatggcaaaggtgctagaatagtcattcccatgattatattatagaaaaatgtccagctggctttgaagaaaaatcttcatgctgtgagagggccatgtggctgggacctgagagtagcttctaggaactaagactcactcccaacaggcagccaacaagaaaacaaggaccctggtcctaaaaccacatggaacttaatttttcaaacaaccaatgagcttgggtcacagtcctggctgatactacaattttagccagttgagtgtattaactatattttcttattttctgtattcctgatgctctggcctctggagcttcactgaatgggaagagattctccacggctagctgtatcttagagacagcaaataacttgcctaagaccatgtatttcatatgtaagccaactaacccagagcccacactctgaaccacctcctgcgtctggttcttacataccagaaggcaatattcttctgccctgatcatcgcagagccagtaaccaggaaactagagaccatccttatacccaagacccactgaaatcattcaagctagccaatccaaaacatgcttatcctgccttgcctttcccatggaaaccacaataaaggctctgggccatgctttctcctcacttcttctgcttcctgactgaccctggtgcttccccatgtagccccatgtagcatggcaagctccctcctcttaactgtgagcaacaaaacagcttttcagtggcacttatctcttgctctgtagacctcatcatacctaattaataataaaacctacatttcaggacagtgagagttcctaagcagagggcccagctaaaacatgttcacacttcctgttcatggaaactgtgacaataaatttgtgttgttttaagctgctaagttcatggaaatctgttacacagccatagaaaactagtacacatgaaaaaaaattatatataaacatactctatctttctctaacctatgtgttcccacttaatattagcatgtatatctccatgccattgaaagattttgagtaaaggaatggaacaattgaagctgagatttgaaacagcagtaaaatgtgggacacgtgagaaaacatggcaggagattatagagatcatctggatccatggtactcagccttggaatcacctagaaacacttttaaaatacagataccagcttcatccatgtccctacaaaggacatgaactcatccctttttatggctgcatagtattccatggtgtatatgtaccatattttcttaatccagtctatcattgatggacatttgggttggttccaagtctttgctattgtgagtagtgctgcaataaacatacgtgtgcatgtgtctttatagtagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgctgtttcctgactttttaatgatcaccattctaactggtgtgagatagtatctcattgtggttttgatttgcatttctctgatggccagtgatgatgagcattttttcatgtgtctgttggctgcataaatgtcttcttttgagaagtgtctgttcatatccttcgcccacttttagatggggttgagaacacttggacacaggatggggaacgtcacacaccggggcctgtcgtggggtggagggagcggggagggatagcattaggagatatacctaatgtaaatgacgagttagtgggtgcagcacaccaacatggcacatgtatacatatgtaacaaacctgcaagttgtgcacatgtaccctagaacttaaagtataataataataaaaataaataaaaaagaaagtaaaaaatatatataaaataaaatacagacacctagaactcactactcatagatattttactttaattaatctgagatacaacctgggaatctggtattttaaatctccccagatgactctaatgcaaagccgaggttgataaccattggcagatagaagtagagagtgctatctcgaattaaagttgtcctactgaaataaaaaatgagagatgggttaaaaaaaaaaagcatttctggagaagccactgataaccaaacagtaagaagactgggaatcctactgcttatctcgcttttgttgttgttgttgtttgttttgttggttgattgcttggttttaattaaatttccactcatctcatttttattatgaagagaattttcatggggagatagaaatttgaggctggctatgcatacatggagtgacaggattgttgaggaggtctcaaggaacattttaggcaaaggaagtggtttgagtaaagtctcaaaagtgagaatcagtgttctaggtaccagcctgaagtgggttgacacagtgagtgaagttcgagtaataaggctgctacacagaggctttgatgccataggaaaccaagagtcattcatattcctttaaaagaatgagaacgaactgatttttctaaacagtagctcagcaagatgacctgagtgcaatataaagaaaagttagagaaaacctagaggccaggaagtttataggctgttacagtaagcaaatcatgagggaacagagcctagactagggcagagcaatggaaacagagaggggcaggacagatctggagatggacctgaaaaaaaagcaaatgtgaaagacctattggatatgggagtgaaagatgacaggggttgcacttgggcttggtacaaaggtaataaggaatttgattttggcattttggttagaggaagggtaaactggttaattagctttcagatgttattgtgtatacccgaaggcagctggataatacaggaaatacatccactgtagactctctcttgcccagggtagctggatgaggaatggatttcacaagagaaacatggtgtaaatatagtagttaaaagtagtttgcttctttctccctcactgtaaaagagagaacttcctttggactattgcatgaagtgagaacaatcacaaccgccaatagagtatgatttttttccctttatagacccccaaggtagaactttctaggtccatatctggttatgatttgtgtttttcgctggggttcaggccttggcatgtgacatgtaagctggtcactcatacctggagcagcagatggttgttcctccctcccttttatggctgagtctgctctgaatccttaggactgtaaattatttactcttcatctgactgaatccatttaatattatttcttaaaatacccctgcctgcactcatatttacttatacttttcttgccaagattttctaaatatcctttctgatatttattttatcagtggaaatactggcctgacacaaattttgaagtaaattgtgaagcataggatcatctttagtcagcccaatgggatttttaagtaccactgtccctctcccttgggggagtcttgtaccacaaacaatggtgtgagatcctgctttccatcaagagtttattggttaatgaagcttgtggctggtgtggttttcctgtgtttagcttttggagctctcagaaacagttgcttggaagagagctggcagaattattgcccagcaaacttgccggccacagcccacaagacttcaccaacgctgacaaattttatggctgatttaatgaatagaacaagtatttgaataaacagagtaaagagctgttggcatcctgctccatcgtctgaagaggtctgaaagtcttctcattaaaccatccttactatctccttttgctctaagccgcgttgccttttctcaagtgcctgaacaggaactcatgggcaaccatagctttgagatgaggtcattgggatggatcctcgggacttagtgcccctaattttaattgaaagggaactctttcaattaaaacctacaggaaccaaatatgacctaattctactttactttagcattccaggcctttaagttacttacccactcttagaacaataatttgtacagttttttgtgtaaacctttgaaaaaaggtttgaaaatttgaaaaaggactcattctttaacacatttaagattcataccacctctatgagttaatgtatcaattagctgtcaccatgtaacaacccactccaaaacccagtggcttcagacaattacttctcaccagtctgcgggtttgctgggcatcagtcagtctggactgggctcagtcattagtccaggttacctgatctaggctgggagtggctctgctgcatgtgttcctccttctcttcctaggaccagtgggcttgcctgggcagattcttttcatggttacagctgacatgcaagagcaaacaaaaacatagaatgcctcttaaagcataagcttgtaactggctcactgttttcttccatatcatcctatctgctaaagcaagttacatgattgaacccagagtcaatgaatgggaaatatactccacctcttttatggaaggaatgagccaaatgacatggatagagtagggggcaaagaattgggggcagtaatgcaatttgccacacttagaaggggcaggtatgacagtttccattttacagatgagaaacctgagactcagaaagctgaaattatttgttcaaggtaacacagaaaatttggacagtgctggaatgcaaaccctactctcaagacttctctgctttttgccacactgaattccaagattccataagaggctgtatgaactagttaaaggcccatggctccaaaggacaactccaaggatgactccttgtggcctgctccttttttctttttatcttatgtccctgggttttggcccatttgcctccttcatagttgtcacctactcttccatttgaacctgtttgaggtaggggttggttaaagttcccctactaaaacacaaattcttccacccctgaaacatacataccagtctctctatttttaataaaaattgatttttaaaagaaaatccaaacgtcacatgataattgaaccagaatggcctcaaacaccaaaatactatagttctttgaagaatgggagtattgtaatcatctgaaatgtgtcaacatgcttattactgacactgagcttcacttaaatgttaataggtctgagctagttttctgttagcccttccctgactgcctttgtagagttccttcaatggcccttgaattgtgaatctgccccatcctgcccagtctggtctgagtcaaattttagaccgagttgctcaaatctagcttgaaaagatttgagctagtatctctgagatctcaagtcattatctgtgagattttttcaggtgtgagtctccatggcaactctatgcctctggttttcagtacatttgcactcttaaatctggcctccagcatcctacaggtagaaaatatcattggatcttaaatttacctcctctaggtttccagctgatctgcactgacagtgtgctttgctctcacgaaccttctagacaaatgtcctcatgagtgcaggctccgaaagtcccttccttttcattggcacagtttgctttcctgatctattattttttttttgtctgcagcacaacttgcagctactgaatgatatggctggccggctctaccatttcagtgaggttctgcctaatctcttttgattctaaggggtaatgtggctcagccacagcaaggaggctgagttctgatgttctctttccccatacttctatggaagactggaagacagattacttgcagtgatttctggaggcagaagataagcaagtggcctctatgatggtagaaccaagaaagaatgatcattgcccttaagccttcagagatgacagctaaatccagagggaaaataaatagggataagattgtaaaaaaagttgctgctggagaaaaaatagctgctgctgataaagaacctcaataaattcaaacaatgtctgcgtttggccctcaaatgtcatgctggctcattgctcgggagaaagagccgtacaactaccatgtcagaggagatgaggaagcaaagaagtctgactaagggcactgccatggatattcttgcccctgctttggaacaatctatcattggattgtggagaggaagcaaggaggcagctggcagtgtgacaccacgtgctatgactcatgactgttttgcctgatggttggcaacatagtattggcacagttgtgggctctagagtacctgggcctgaatctctattgatatgtgccatttggcaaatttctaaactctaagtcttagctgtctcatatacaaaatgggcataatacatcctccctcatatggttgttgtgaggattaataaaacagtgtttataaagtgcttggcacagtgctgaacacatagcagtaaataaatattagtcattattaatattagctgatgcacatttgggggcaatttcaagaaagaattgattacaatagtaaattcagactatggcatctattgattgttcctttttaaatgaaccattttaaatacagtaaaagccctcctccctggcctctgcttaacttcctttatggagtaagtcgatgtttttccttcctattggaatatacactggccaatgctcagggcacaatggaagctcatgggcaggtaagttacttctggtgaacacttatatttctgcttccacacaacaagttgatcacttaccaaaagttagctgtgtttttgccaagcccatttatggcagttgtactcgttattacaagtaggtaatttaatgtaaatttgtgaaatatgagtataaaaagaaaactattattttcatgaaaactaagttcaatgctttggaaagacttactaaagaaaagttgcttttgaaaactgccatattgttaaaaataaaacaaaactgaaagtggaaatcaaatgtgatgcattaggaatgtaacttacgtgaaaaagagtctgtgaaatcccagggtgtggcctcacgctcaaagaaaaggccttggccttacaacacatcaccagagtggtgaatgaatgtacctttgtgtgttttaggttgaaataaaatgttttatgtatgtatatacatgtgtgtatgtatgtacatgtgtgtctgtattgttttatatgattcctcactttaacaaattatcacttactctaagggctattcaagaaagcttctactgtatagtcaatgttctatgttaagtactttacgtgctgtgggcttacaagaagggagcacagtccagtagaatgtatttaccgatttatggattggagcttgtggtaggcagaataatgcttccccttctcaaagatgtccacattcctaatccccagaacctggagatatatcatgttattggcagggggcaattaaggttgcagatggaattaaggttgctaatcagataaacttgagttgaggagattatcctggatcatctggatggtcccaatgtaatcacaagggtgcttataagtggaggaggtaagctgaagacagtgtgtcagaatggtgttaggtgacaaagacttaccctgatggtgctggctttgaaaatggaggaagaggccacaagtcaagggatacaggcaggccctagaagctagaaaatacaaaggaatggatttccccctagggcctccaaaaagaaatgccattctgccaatagcttgactttagcccagcgacatccatttcagacttgtgacctaaagaatagtaagataataaataaatttcttttgtctggttttaagcccaggtttgtgataatttgttatagcagcaataggaagctaatacagaggttgagtcaagttgatgacaaaaaatcctatccctaaatccctattccaaatgtactcacaggatatctaggctcttcatgctttcacatgccctaaacataggatttacactaatatctgggtctaatcttagtagcaccatgttcattaagtccataccatttgccaggcaatatgctaaatgcttcagcaaattattgttatatgctgtttatagtaatgcttaaatatattctgtttcagaattctatacttacatattatatgctatttatagcatataacaaattaccaccaatgaacaaattaccattagtgaacagcatagacatagggcatgtctttattgagctttcaggttttgcccaagtacacgttttgaaatgagaaagataatagtgaaaatagcctgaatatctttatatttcaggaaagataatagtgaaaatagccgcaatacctttatatttcaggactgaggaacacctgcagtgtttgggggttttttgatcttttgtaaaacagaagatttaagcattactagctccattcttcctttagtcctttccctcagttggcctgtgattgtgactctggcatctgctctttcacctatttccccatcccaccaagtgattttctgaaattctgtcagcacagtcttccaacatcaaaatagcagcaaaacagatatttccaccaaggaaaaggaagcactcttccctcatgctctatcttcccaaggttcattttaagccaagttcacttcaagctttccactgcactcatatattttcttgcattcaaaataaaccacctcatcaaaccaaagtctctcccagttatcaaatgcagcttatgtctgcctccaaggatgccctccccagccctagctgctcacctttgcctctatagtacatatagttctgagtcatgcattaatatcccttattatttactgtgttgttttgttctgtttttttttatgtatgtcatctgcattttgacattttcctgaccagatatcccttcagtggtttcccacttccttcaggataaagtccaaactcttcatcatagcactctaggtcttcatgatctggtagccctgtctttctcttccaacttcatcccgtgccattatctctctctctatcctcagcagccattctgatatcttcaaacattgccatgttctctttatcctctggaccttgaacacactatttcgtcttcctgaaatagtgtttcatcaactgtttctttgtccactcccacctctaccctctccacttggcttcctcacccaacagttcacaacttgaatatgacttactgtaaaagttacccttgtattagacctccttagatactagcctccctcagacacgtaatcccttagcaccatgtatctttgcagccccaggcatttatttgtagtacttaataacttgtaattatttagagtttttgtcttcctctagatataagttccatgtttgtcaaaaaaaaaaactgaataggtgaatgaatcaatgaattaatagtcttttagtcacaagtttttaaattgtttgctgtcactctcctccaactagaatgcctgattttcaaacccaaacccaattatgattctttagatccagaatctgcattttaacaagccccccctagatcattatgatgctgaatgtccaggaatcatcttttgaagaaggctaatatggattttgaatgggatgtcaaagcagtatagggacctctcaaataataatatcaagtaccactgatggttactgtttgtttgccaggtactgatctaagaagctttatagaaagacattacctaatttaatcctttcttctagcctatgaggaaggtactattgtaatcccctattttgtagataagaaagctgaggttaagagaggttaagtaatttgctcagtgtcacacagctagtaagtgatggagtgattcaacatattctgcctccaaagcccatgctctttcccttaattctaggctgcttgttcctcacagagttttcctcatttgcagacttcaggatccttggcatgcttaatgtgcacttacctctccagtcctattagaattacgatctgttgcctttaaagatgcttctttgtaggttaccaagaggcaaaaactctgtctccctgcagttctttgttctgcacttgttgaaacaacaggccccagggaaagaagcccttttttagaagaaaaaaaccatgttctttcttctttccccacataccatattaattatcaagtacagaagaaactgctgaaacttctggctcacttggctcttctcctccaaagcaggaagtagcacagcaagagacaagtttaattctgaagctcaagcgctctcctgcataccatggcctaggagaaaggttcagtgaactcggtattagtccatgataagacaggcttctataaggtagaatgtttatggaaaatagattgggatatacaaacaagaacatagaggatcccatcagggatttgaggtaaacattaagtgaactcctttcatgtttggcctttcctgtacacttggtgttaggaggtcttacagaggtcctctgttaacccaatatgtatacagtagataaattactctgcataaagctttctacttttaacagaagctgggactgaaagtgcttcactgggtagtagaggtagctagatgatagatctctctattgcacccacctccggcttttaccttctcctacttcagaacagtgtcctggcagacaataatctcgacatttaagtactatccctagaaacaaaacccaggaaggactctctagaagtcattaactttctgccagactggatcgaagataaagatagcaaatagtagttgtatgcccactcaatgcatgggagtggctgcctaggacaatatagtgagaagaattatgaggccacatatgggcactatagggattgattattgatgtctgccatggacatgaaaacacggagggtcagcaaacaggctaccttttatccatccttgcaccaagccagtggctcccaaacctaattgcacatagaattactgagagctatttaaaaatattgatacctgggatctacccccaaactaattaaattaaattatctggaggtgagattcaagcaatcaggcattggagcaacaaaggttgagagccactgctgtgcacagttgtagacatacagatgacttaattcagtagttaccaaatgcatttcttccaatcaggacctgccaggatggcttcataagaattatgtgaggagcttgtaaaattgtggattcctgggaccaactcctaaaaattctaatttggaagtatgggggtagaatacaagaatctgtattttttaaaaccacacaggaagatgttgatgggaaccacggtcctaagctattctcaatgcctcaaatgaatgagaactttgagcagaaccttgtactctaggacaaaagttttcaaccctaactgtacattggtatccccttggaaacttttttaaaacaccaatgcctaagttcatcaattaaattggaatctctagggtggaatctggatgattcgaatgtgtaggtaaaactgagaatcactggtctaagaagtggagcacaggaatctcatttggggacctcatcagaaagattttattgttctttgtctatagatttagtccctgagttagtctagtagcttcagcttgatattagatggtagaactgcttctgttccctgaaccttgtttacaaccagaatctgtcattcatgatgtttgtggtggtctcatgaattatcctggacttagtaaacattggctgcaatcactcacccatgcttttaaacaaatggttatggaatgtaccttaatgtttgtgaaatgtagattccaatatcttctactagtctaaagaaaggtttttgatgagggtttgtttatttttaaaaaaataatcaaatgaaatgtaggacaactgatggtcttaagagacagaggctttgtaaagacaaagttgtatttaaacttggaatcttgcaaggcccatcaactatgaattagtaggggcaaatagacatcttaaccaccaatccgtgattggtcctactggtctcttttgaagcaactggtaaagatataatttctttctcttagaagctttgcctgtatgtttatttgcctcacattagtcgtgtaagacagccagacaacctcagacaatcagccttgcatggatggtcatgaagtggtgagactggtagagttcagcaggactctccttcttcttcaaaatgcatttttaaaaaattacacccagttttttcacttatgcttgaatttccaccattagtgattaatgtatttggtttaaacattccctcttcagattactgtttctaaatataaacagaaataacacattaagtccctccaatactctcaggaaggaagagccatgactgtcttggaggacctcacaaatacagcctgaggttgagaggaccagctcttcatgttaatgcaagaattcaagggtcaatcctaaggagcaatgggaggacagtgaactagggcctattcatctctctagccccaatgtcttacattagcacctggttcagagtagtggaaggaatggcagccaaagaaaatataccatcttagaactgccatgagaaattttgaatccagccttggactcatccaaatgagacccagcagctgaacctccagaagacagcctcaccagccttgtaaacaagatcatttcctttacccccatggaaaacaggacccaacaaatcccttgctgatgcaataccacatgttgtaagaataaaccattgtgtttttgccaagagttggttatccagtgactaatgtgttcctatacatttacactcactgcagagtatcctgggacatgtttatagttaagaaaggttagtattaacattgtgtcagaggattaatccattttaattgtaaatgccaagaacaaacctgcttccttggggcccagatgtatgactttggttaaatatttatagatcagatggaatgtttactcttaattctggagctaggtatttacttgcataattacatactcctcccctgcctcctcttgatccagtgtcctcctgatattttctctctgaaatacaagtgtgttgtgggagatgatgaaaacatctggccaatggtttagagctactgatactggtgagaggtgactgtgggatagtagagtaactaggaaaatgctctatgtatataaccaggatcatggaatgagcaggggccacagaagcaggaaagctggattctagttccaactctactggaaattagctatgtgaccttctctgagccccattttcctcatctataaaatgagagagatgaattcaaatttttaagacttcttccagagatgagccttcatggcagctttctctaaaccatcttggaacccctacccactccaggtataatacttatgctttctagggcagtaacatccaatagaactttctgcaataaggaaatattctacatttatggtgtgcaatacagtagcctctagccatatgtagctattgagcatttaaaatgtggctaatgtggctgagaaattgaaatttcattttgttttattaattcaaatttaatagctatgcacaactagtggctaccatatagggcggcaccatgctaaatgattagcaatcgtgttggccagctccttgaagaaggccattgtctgtgctaatgatgtcttctaatttggggatgattaaagaggtagttgaaaaatactgctcagtgggaatcctttttctccaatgtggaaggtaggatacagtcaaatattgtagatgccttgaggttttcaaaatgcacaactcctgagtttttatttattccactaaaaagtggaaaggggtggcaagtcattgaactaattttcctttttttctatctgaaaactgttaatatgcttctagccacattatgttaaattaggaaaacagtatcaccatagggcattccaagacatacacagcagattccacagaatcaacttcaatcatcccacattaaacatttttcatacaaaaaagaacgtgtttactgcattagtccattttcatgctgctgataaagactgggcagtttacaaaagaaagaggtttattggattcacagttccttgtgactgggaggcctcacaatcatggcggaaggaaaaaggcacatctcacatggtggcagacaagagaaagacaaagcttgtgcagggaaactcctgttttaaaaccatcagatgtcgtgaggcttattcactatcacaagaacaccatggggaagacccgcccccatgattcaattatctcccactgggtccctcccacagcacgagggaattattggagctacaatatgagatttgggtggggacacagagccaaaccatatcattcacttaatttgcaaaatgtttcttttccatttaatagtttgttgatctatttcccatagcattgatggcagagagttattaaactgtctgacttaaaaacagtgacaggtcctcattatgcaactcattgagttgaaaatcagctatggaccagtagatagatgctgtttctggacttgacttttctgctttcaaatttataataattgtaataatatagaaaataattagtattattattaaatattagtattatagctaaataattataagcatttcttatctagtcgagacttttctgtcatactttttagagagcatacgacactcatgataagttttagtgcatccgaaaaaaaaatactaaactttagctccataaactggttagaatggaggcttctaattagtatgattcagttcccaagtgatagtatctatatctggaatggtaaatccatcgcacgaaaattgtcatttctcacctcttcatttgtctttggcattctttcctgctgagtttggacgtagcctcagaattcttaacacagcattttaggcagctagcatcaagcagctagggcatttaaattacaacatttaagattaaagttattttccctctctaatctttgcaggtggttgtgatcaatttgtaagagataaaaacacaataaaatacatacagtcctagagctgaaagggaccttagagagcactcaaccttaatcctcttattttatagatgagaagagcaaggcttaaagaataatggggaattgtccatggttacacagacagttggtggcaaaaagtgggactagattccggcctcctaactcggagagaatcccgcaagacactgccttgagcccaccatgtagtagtacttgtacattagatgtttggtagatgattataatcacttttaagtttactggaaatgatttctgcttgcctggaccattgaggctagacaggcctggctattaaactatgataaactatttatttgtggggtggtcatatccaaatagattatttggtggattttcccataagttagacttacatgttttccaggcatctgtgtccagtgccacctgattagaagaaagaaatagcagcccattaatttaaacgatgggattaactgtggggtcttactgaaagaggagctgcttatcagggtctgctggaatgtgtagctctgattaacaaatgcagtttccattattataatgagcaactttctggatgtttgcctctgttaatgtgttgttctccacctaataatttactcctcttacttacggtctatgccttcaatagggactattcttattccaaaattgtgtttattaagtgtactaacattgatatcactgtcaggcaatatctaagagtttagccatcacagtttcaatagagaggagagaatcctgctattccagtcagaggcaacagtgggaacataggagtcttggttaccagttctttaagttgttttttatgacctaaagttttgaaatgttaagtgatttctaaagtgagaaataccattattatttattaaatactataattactacaaatggacactcaggagaggaatataattgtggttaatggcattatcatttaatttgcaggtgcatctgtttctaaacaaatattcagtgcctctgtttagaacacatgtttatatcctaaggtttcccctgctgctgaacattcccactgaagatcaagttgtattcaggtagtttaccttccctcctttttatttccttttaactatttgttgtgtcttaaagattccaatcttgtttttgcagttggttccttataatcctttaagtaaactaaatttcaatgtgcttgaagcagctcagttttccaaagtcattagtaagataggcctgatcccccagtttccactggaagactcactctttagctaagtgacttatacctctagttttcattacaagactggcttgtcttttgccatatcctgaggtctaggaagaagtgggtaagacacccaggtttctttgacagaaaagagggtgtgagtgtcctctccaccagagccaaagtgtaaaaggtaaagttgtaaaagtttgtttttttcatatcatctcagctcctcctttagtcaggccccagagttcatccttaacaagctgtcttctgttttgcagatcatctcctttaagctattggctcctaaaatgttatttctcccagaggtgtttttagcttgggggaggtccctcctgaagagcattataagtgtacactcataaaaaggaaagtctgactgccaacattagccccttcaacttctgacaaacattcttctttctcgatcttgctgccattcccttccctattttcatatagaatcaaaaaccttttgactattcaaaacttaaggtatcttatccctcacttctatccttctttacctcattacccacgcgttactcttaacctcaaatcattcaaccatgaaatatttccagagtaaacatcttcactcatacagcaaagcatgattggggaagaaccttttattagtttggtacctctgtagagcagcttccaagatcgtattaaatatgcaagagatcttccgggggaaggtgactttgagagaaaaaaaggaagggagccagaggaggtgtgacttatccgaccacagggcaggtccaacctctgtggaggagagaaggaaggaaagaggtttggacaagcagagtctcagattggagcacagttctaagaaagtttcagccaggccaatagagttctgaagccagaatcagtgatcagaggagttttctgtctcacagtaatgggtctaccttagtattcttaccatgcacagtcattagctgagaaatgcccactggacacgtggccttggctcaagtgcagtgatggactcaaggggtcagcaactaagtgcatggatcaaatatgctccctaaagcaggagatccaagcatgactgctacaaaaccctaataatcactgggcttggttcactggaacatcataatctccagctgctactctaacttaagtattacaagtaaatattatttcacccatgtcaatgttgtggctcacagcaaagtttgtttgaatcaaccatctctttcctcaaaacccggtcagttcctctttccttaaaacctctaccatcactaaaagctattactcatgttttgtcatacaggcaaaaaattaaaaccctcaacttcttgccttggttcgtctttctttgccttttccagttctttgagagataaccatcctcattttcctttgggacctccaaactactttcttcccctcttgtgtttccataatcttaaactgccttcctcctttctgctattagatgtatccatgcttcttcaatcttgcataaaccttcactctacctcaatttgacatccaaattattttcctctcattccacacttgctgccattggttcagtatagtgtagtacagtgcagtatagtctagtatacactcaaatttgaataagaaactcaaatctgaatcacctgctgggcttggaaaacaaagattattagactccacctccagagtttgtgattcagtaggtctcggggtgagtacctgataatttacatttttaacaagctcccaaatgatgctgatgctcctggtccaggaaccacactttgaaaagtactggtatggctgttaaagagtgtgtcctctagattcaattagcccaagttcaaatcctggctctgactcttaagatgtgtgaccttaggcaagttcctagcccctctatatctcagttgcctcatctataaaatagagataacaatgatccctacctcataaggttgtgaagattgcatgatttaatatacatgaagtgcttagaacactggcacttgcctgacacataataaatgctgtaaagtgttagttattatttcattgactcaggatgctagagccagtaagaaacatttaagcccatcattcaccaaatccaagtcaaaatgtgcataactcttgctatatgtagtatttattattttaataaatgcttttctttaggttggttctcaggtttacctgaataaatttatttcagaatgaaactgggaatggaaaaccagtgttttgctaatgtaaaataaaatacatacaatacaattagaatacaaaagatttacccgtgtggtttgtgtattcctctttgcaaaaactctgatttcactatataattcttcttttttcaaataaggaaactgagatacagaaaagggacttgcttatgatcacagaaagttggtggtagagctgagactaggtctcctgtctccctggctagtatactttacgtaccacctcttgaagaaatgccccactcctccctcctcctgccttatgatgactccatggcagctgtatctctaatgctgaagatacttaattttctatgaagccttgatcattcaacttaattttgtatgttctgtgaaggtatatgttgttatagcacagatgttttggctgtggttgattattgtcataagagcttggagttgaaagagagtccaaatgtgctggctgctagatcattaggtggaagtgtgaaaaatgaacatgggcaagcaaagagtcagagtttgttaacagggtgaggttggcagaaccagtgacaagagaggactgaaaaacagattcagggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctctccttggtccaattcaaacagcaggctatcagagcagaactttggagaaagctctcttcaggaagtagcccccccacttccatttgaggatgcctttccttttttttttttttttttttttttttgccccctgtgggactcagagtggcttgagcaatcagcaaaactaatactgggggttctttgtatatttgctctcaagatgggtagagccttcttaaggcttccaacttttggaaagctttcctggcagatctagagaagagtttatacaaaacttgggcagagttcactttttccctgaggcaccattttccattgttacttttttaagatcactatagttaagaagttaggatttgcccagataaggttaagtaaataaaatgttttactccactagtggtttctccaaacctaacttctcctctcctcacctactcccatacctccaccccagccaccacattcctggcatgtactcacctctgacctctattccattccacacaattcccccaagataagcaaaactaatacaagtaggtatatttagagtgcctactggtatcaccacatctattgatgcaagatttagataagtgtgtgagccatataaaatggacattccagcctcaaattaatgtgcatttaacatgtacaattgattgatttcactttttcttccctaggcagcaactcattattcccacttgcattttagcaaatcaacctgtcaagttgtttgggactaggagtgtgttgattcaaagtgaaccaaaaaaaaacaaaaaacaaaaaacaaaaacaaagtgaactacaagaattccctgatgtcaactgcaactgtctagaagtgcttttgttgaaaccctgtttctgccaccttatggaagaagattgtagaatgaaagtaatttctcttaaattaagtgtgcccataggattacaggtatgccaccgacatgctcagtaaaatcctgataggctagaacctttgctatctggaatgtttgtggcattcctcttttaggaggaatcatataccataggaaaatgatctaagaaaagatcagggatataagccaggaaaaaaaaaagcagcctccaggtagtgtccagggatcctcagtcacttagtctccctcctatacctcttatacctgcagtctcagacaatggaaaataatctactggaaaataacttggcaacacagctagtcctcaaatagcaaagaaagattttctgtcatctccacttgactgtaccttgtgaggcaggaaggttgtgtctgacagtttagaaagattttcatcaataaaagttttccccttaggcctcagtgaaccaaacaattctgtaaacttgcacggtctattctccaagaggtcccattatatgaaagattcactgtaatctctaacaaatgccttaataaagtaatgggctatctgacagatgggggccataggaacccacaaatcctagaataaaattcccaaaggcttgtgaatcaagacagtgccatatgcacttaggaaagaactaggggttatggatacgttccatcctgtcctggactccactgggctggatgcatcctttattcttacttggttcctgggcttttacatgcaaatcaccaagtggtatcagtacctacacagggctctaggattctcatttcaacaaatatccctcaaatatttcttgaacacctaactgggctgtatggatacaaagatgaataagacgtagtccctgccctcaagcagctcattacatggtgatagaagaagaccaggatattaacaatcacaatttagagaggtaaatatataaaggtataaacataatgtaatgtgaacatgttttgttgatttaacagacagtgggagtatctataaaactgattatttcctttgttgatgaccactttgttattatgggttaagatcagatttatctgaacaataatttttaaaaagatagatttttgtgtcctacaactttgcttaattcatttattagttctgagagtttcatagtggagtctctatggtttttttatataaaatcatttcatttgcaaatagggataatttgacttcctcctttccaatttggatgctctttgtttctttttcttgcctaattgctttgactaggagttccagtactatgttgaaaagaagtgctaatcacaagtgggtatccttgtcttgttccagatttttaagggaaagctttcaactttttttcattcagcattatgctagctgtgggtttgtcatatatggcctttactgcgttgaggtacattccttctatacctaatttgttcacgtttatttttatgaatggatgttatcaaatgctttttgtgcatctattgacatgatcacatggttttgtccatcattctattaatgtggtttatcacattgattcatttgtatatgttgaaccatccttgcatccctgggaagaatcccacttgatcatggtgaatgatctttttatgtgctgttggatgttgtttgctagtattttgctgaggatttttgcatctatgtacatcaggaatgttggcctgtagttttctttttttattgtgtcattgtctggttttaatatcagggtaatgctggccttgtaggaacagtttggaagaattccttccattaactatttggaatagtttgagaagaattggtattagttctttaaatggtagaactcagcagtgacactatcaggtcctgagcttttctttgatggaggacttgtttatcacaatcttactactgggtgtatatgtaagggaaatgaaatcagtatgttgaagagatatatctgtacttccatgtttgttgcagcactatttacaatacccgacatatagaatcaatctaattgttcatcaaaggttaaatgaatttttaaaatgtggtatatgtacacaacagaatattattcagccataaaaaagaatgaaattctgttatttgtgacaacatggatgaacctagaggacattatgttaagtgaaataagccaagcacagaagggtaaataacacatgaactcactcatatatggaatctaaataagttgatcttgtagaagtagagggtaaaatagtgattaccagagtctagggagagtagggagaaggggagaaggacattggttggtcaatgggtataaacttatagttagataggaggaaaaattcttgtcttctattgcatagtagggtgactacagttaacaatagtgtattgtatatttcaaaatagctagaaaaaaggattttgaatgctcttaccaaaaagaaatgacaagtgttgaaggggatggatatgctaagtaccctaatttgatcattaaataatgtatacatgattgaaacatcacactgtaccccataaatatgcacaattattatgtgccaattaaaaacaaaacttttaaaaaaggcaagtagaaaaagaaaaagaaacataattcgtcataaccatacactgtagaatatatattgaccagcataaaacttgttgcaaaatatgtttggcatggaaatttatgtttgtgcctttatttactctataacattacttttgtttatctgtctctcctcctataatgtaagctacttaagggtagggaattttgtctatttcattcactgttgtatctacagaggcagtaaatgtataataaatatttgttgaacagatgagcaaatatgaataatttaaaattatgataagtactatgaaagaagttaacatatacgattagagattataacaaggggatctgatgtagactggggaaacagtttaggcctctctgaggaagagacatttaggcagagacatgagagagagagaaggagttagccaagacaatcagacaacagacagctcacatctggcttgcaaaggtctctggaaatctgatgatgtttggtttcaaatgactcacatttgcaggctacttggttgatacattagggaatcagtttgattgacatattagggaatcagtttgattgatagcaatttttgtgtttttcctgttcaaaagatgttttcattctcccatctatatctaaatctttgggtttaaagccaaggaaacaaagttcagactcaagtttccctcctgcctcagtccgcatgtggaatcctgagttagacttagctctgtgcatttggccccttgaaactcccctgtgacccgtttctggctagcacctcagctcagaaggctcttatttcttggtttgcctggcaagagatgggttcaccatctggagtcaaaaaaacagcctgccagccactgaacagttcagcctaggccccggacaatgagaatcaggcaatagccaattccttgtctgcaatttgctgattatcacaccccagggtgtgggattgtacagccaggactgctttgctctgcctctcatcaaggcagaatgaacacagatcctgacaggtcaaatcttcccccagacctcagaggttgctgtacaaaggaccaggcttaatctctggccaagtgtataattcatttatctgcacggtcatgaattctgggctctcagaattctgggctctcagggcaggaagcatggggcattgtgactggttctacaggcccagggagtcacttaagccttgattgtattgtggagggagggattttcgagacaaagggccctgtcctcccgagattgagcagatttgaaggggagcctatgcacacaaaggaatggtgctttagggagaggttgacagccttgtcatcaatgtccatgaacttctctagatcatctaagtgatgacaagggggctagaattaattatttcatagactttggccaagaggaattgagataaataaagagttcatctcaggatgtttgcccgatgctcattcgccactttgtagtggagggaagttttaaacaccgagaaacgttttctcactcggccccttctcagaaacttgttgggggtcttaatctttgcctccagctttcagagctcctttactaccaccagaaagacttgaagtaaaaggcagtactctatagagaacagctacattaaagcgaattggaaattgtttagaaatttatagtttcccaacttggccagctgttttgctttctctgatcctccagacttcctgctgaacagagatgggacttggatgccattctgtgttcctggagtttcgtttgcacagttccacagcctgaggggggttgacccattgcaataaatccagcttcagattagttatttggattttgaagtatttcaagctccgtgtccctcatgtcacttcactgcaacctaccttgaactttgcaatggaagacattttaatcatggattgtatattatacaactgcagactcctgaaagggaggaagtggatgttgtggaaggcagatagcgctggagaggaatggagagaacagaggctctagtgcttactcttacctcggacagacatttcacctctttgtgtggttaaaaaaaatcctgatgctcctccatttttccttttctccctattcatttttggggtggatgtgaaggacatgaggaaaccccaagtgcagacctccccagctattcctgacaatcattcttcacccctatgaagatatctgagtgctgtcattatctgagattgggacactcattaaatacattatcagtcattaatgctttacccctcaaatacatttaataaattagtctcagcaaaaattggaacccctggggaaatggactagaagtataaagctttctgggatggctggacaggattgtgtttgctcaggctttttactctttgacacctggtttctagatcatcagcaataactaaagattccctgcttcatatgagtttcctcatttgccagtcaatagccttataattagtagaaatatgagaggactctatatcctgttgtatcccaagcagtttattcaggaagtctctactaaacacttgttccagcactgtactaggtcctatagagcagcagtctccaacctttttggcaccagggactggtttcatggaagacaattttaccacagaccaggggtggggtggtttcgggatgatatgagtgcattacatttattgtgtgctttatttctattattattattacattgtaatatataatgaaataattacacaacttaccataatgtagaatcagtgagagtcctgagctgcttttcctgcaactagatggtcccatgtgggggtggtaagagacagtgacagatcatcaggcattagattctcacaaggagcatgcaacctagaccccttgcatgtgcagttcacagtagtgtttgcgctcctatgagaatctaatgctgctgctgatctgacaggaggtggagctcaggtgataattcctgtgatgggaagctgctgtaaatacagatgaagcttcacttactcaccctctgctcacctctcactgtgcagctcagttcctaacaggccacagactgataccagtctgtggccccagggttgggaacccctgctatagaggttatgtcttcttttaatgagcttgctttctagttgtggaagatatgtcaataataaaacatgtaacatatatatctaagaaccatctgcttaggtaatacaatgagtgttagacagagagttttgtagtggtgtagcaggtggatcagtcagaaccagcttcttggtggaggtgagatttttcctcgagccttgaaaaacagatatcattttaatatgcagagaagaagggagagggcagtctgtgcaaagagaagcacataaaccaaagtccacaggtgggaatgagcccattatatatgtggaagttcacatgaaagagtaagggtagaaaaaatagcttcagaccacagagtgaagtgcaaaggaatatttatttgatcttttgtagcagtatcctcaaaacctttttgatcatacacacatataagaaaaatagcacaccctcaatatatgtatattcatatactgtatacttatactaatatattagtacattataaaacatacacaaaatcatacaggatgatgtaatacaatgaacaaaatagttctgatagtttcttctcataccccagaaaaccatcttgtactctccctggggtatctgtacccctactctggataccactgctttagagcatctgttaaacattttggggaccacagacccctttaagaatctgatggaagctacatatcctctcctctcctcagaaatgtatgcacagatgcttaacattttcttcatatagttaatttcaaggaaaggagtgggctatggacctcctgaagcccattcttataccccagtttaagtttctctgggtggagaaaggcacagaaggcttttgagtagcttagtggtacatactctttaatcttttaggaagttgaatctggtagtgtgcaaaatgaattggtggcagtggggggcaggtggacaaaaagtagaagcagggaaacaagttaataggctatttcaaaacttcatgccggaaatgcaaatgctatgtaaatagaaaagagaggacagatacaaatggtatttcaaaggaagcataggcagatctcaatgatcaatagtggatgaagggagaagggagggaagagaatcaatggcaagtctgaggcctcaagttgggggtggtgggggaagggtaattattaactggttcagatgacagcccagcaccccagcagacatggtctgagggcagggggaaatgtggggataaagctagggagaataattggataggagacacagattggggtgttgatatggtgagagtagaaagtttatgagaagagagagaataaaaatagtaaacacttatgcactaggcgttgttctaagtgctttatatcaattgatgctgttaatcctcattatcatctctggaaacaagtgctcttattaacatcgttccattttataaacaggaaacagagataaagcagcttgcccaaggtcacaggctaggaaggatcagagtaaggattcaaacctgagcagtctccagaatctatgcctgtgagcactgtgccatgctgcctctcaatagtgaggggtgagaggtgagttgtgggaaagtccacaagggaaaggggaaaagggaggaacagaggaacagactagaacctatcgagtgtccacatggatcaggcattgtactagtgctctaatattaataagcgtcatcatcattatcaccaagagttttccatatgcaaggccctatgtcaagaactttatgaggtatagtgaatatttgtcattttttaatcactcagcaggaaaatgcctttgctagttgaaaagaatccctcattgtatgagtcttgatgtgagttggggcccacctctcactgcggaagccaaaggagttcagataccccccttcctgtccctgtgtagataggaagtggtcataggtcctaggctggactaataggacactttctctgtggagcaactgaagctaagatcatgagccagagttcaatcacagtagtagtcagcggctgcgattatgataccctggccagattgttcctgctatgtagcttcaaaagtctccttcaccttttcatctgttctggaagtctatatcatagattggcaaaccataaatctgacccatcacctctttttctaaataaagttttgttagaacacagccacatccatttgtttacttattgcctctggctgcttttgtgctacaatgatagagttaagtagctgtaacagagacagtattgtccacaaagcctataatatttactattggactcttagcagataaagtttgaccactcctgctctttccagtaaatccatttttggcttaatatattcagagttgacttctgttgcttgcagccaagaactttaactgatataaatggattatctcatgtaatccttataataaccctcccaagtagatgctattgttaatcgcatattgaagataataaaacagacacagacaggttatctgcccaagatcacacagatagtaagtaaaatcactgaaattccaacccaaatctgactctatcatacatgaaagagataaagaaaatggagatggagcaattagcagtcccaggcctcttttgagatactggagaaaagaatcattttcccccagtagttcagaggaacccaagtaatcagggccatggaaagtgagaggaaaaaggaatagagatatcagtagcttggttctgacacatttatctccctcttggccacttctatacagtctattgaaatgttggtttaagcctctgtcaaaagggtacactaacctatcaattctcagatcatctgccagctttttgcttgctaagaaattcagaattcatttgagttgcatctcagaactatattaggccgtagagcttgaattccttcttccagatcactgggacctacactggatccagactgacagtagccaaagtcattgtttcctctgctaaaatatgcaccctttgaggacagggtgtaaggcttgctcactgctgccacctgcatatcgaaatatggagtctgtaccctctttcgaggtggctcaagtgcagatgaccacaaaagtttatttgataggcaatcctccatcgtctcagtgtggctggggcagattaccactttcactccaggcttagcaatctcgagcttttgctttgctaaatgctaagatacttgccaatacgtcacagctttgggggagtacgtgggaggaggtttaagcatatttagcttttcagccttacctactagacccagagttccttccatgtgattcctgtaaatgctgacaataacatggtgctccctctgctcagtgcaccatttaattgagctaattagtgacaaaaatatctcacagcagtgagccttctgttggaagcatctgaagggaaggaggatcaaactgcagagtggtgaagaagacttcttggataaaggcattgggaatgttatcggactgacctttttgtttgtgtgcacacatgcacgcacccttctgttaaaatagtcttttaaactaggtgggaaagttcatgaaagacgtttgtcttgtcacatgtactgatgaagtgttttcctctgtgattttacccccagcaaacttctctcaccagttaaagcagaaaaccctacttctgccaagttgttgtttgcaagagaatttgtgaaggcctgccttttgtagcacatgacttgtccctcaggaatatctttttagtctctgctaatgtaagggaacatctgaatggtgtctgaaaagagaaatctcttttccttgggtcaagcctagccctgtggccacctgatctggctcttttttggatgagtccctggggctaacaagcgaaagagtgaaccttaggaaattgttagatattttcatgatcatttcttgattatctgcatctgggaaagaagtggtggttaggacagttgaaccaacctaaagcttactcattccaaccatttcagcaccctcaaacattctcatgacctaatcatcatgctatggtcttgttcacgaagtactgaatccttttctaaagcccttttccattgaagattcagacttaatctttacagcaacccagtgaaagttccatgatgaggggcaacgctgtagttcagttggttagcaggtcaaatgcttaggtgtgtgtttctaggtgccctgatcctaagacgtgaggaattgcagcattattggtcagccaagaagaagcagagcctaagtaaactgagctcacagtagaatgtttttgtgattagtggccaatagcacacagtagatgaccaaaaaaagactatgggttttcgccctaatcctttgattttgctataaaagtctttcaaggtagatatattcttttctgatggaattcaatgttgatttcaagaactccagctctgagaatgctgcttagaagtgaacactaaataacatgttatggcagcccagccttgcttggtgtgatcagagaagagtgatagctctcttatcattctcctgtgaattaagcaaaaaaaaaaaaaaaaattggtgaacatacctgaagggttattcttcacaggattttccatatgcccactcagaaaaaaggatcatatgtcttggttaagaaaatacaaataataacattgtccacagtgtttctcctgaagagaactaaaagagaaaatgtgaccgctgtccttttataaacatcacataagctctcccaggttttggggaagccactgatgtccttgatgaatatgactaagttgtttgtgtaggagggtgttcatgtctatcctgtaattaactggtgaattgggttgatgtttctccaagcatattctgtagcttttgtgtatgagtgatgcatgggtatgtgagtgatgcatgggtatgtgagtgatgcatctttgacattgcattcagttcaactactatttagagcagaggttcccaaaccttagctgcacattagaatcaccttaagagcttttaaaaaccccaatgtccaggccatgccttatcttagtcagattgaactgccataacaaaattccatagactaggtggcttaaacaacagaaatttattttctcacaattctagaagctggaagtccaagatcagggtgccagtgtggtcaggttctggtgaggtctctcttcctggttttatggggtggcctggttttatgctgtgtcctcacatggcaagagagaactctggtatctcttcctctccttataagggcaccagttctattggatcaaggtgccactcttatgacctcacttaaccttaatcacctccttaaaggcctcatctccaatacagtcacatgggggaggggggcttcaacatatgaatttgaagggaacacaattcagttcataacataccctaaaataattaattaaatcagactgtctggaaatgggacccaaatctcctaggtgattccaatatgcagccaagttaagaactactattttatatccttgctgttcaatgtgaagtcgcttcagcagcatcaacatcacctgggagcttgttagaaaagcagaaccttgagcctcccgctgaatcagaacctttttttttaacaggattcctaagcgatttgtagacacaggacagctgagaagaactgattgagagtatctagcatgtttctaatctagagagtcttcttctttctttattttgccaaatacttgcaacagtagctatgtgagctttttatatgctatgggattgttctcagaacaaggtgcttgactgtgcagtcttccaacagttgcttaatggtacagaatacatgaggtggtgcactggtgagtttgagagggccaccgaagacatccagactgggtaagtctcatcactcactcaggtgccatgcacattgctaggtaactgccagggagtgagtcaagcgaccacttttaggttctcttctgaaaacaggagtatagtcctcttgttcttcctggtgatttgtttacttttggattgttttcacagaattgtgtcttctaaaaaccatttatttgcagcttcttgttcaggctatagatttcactcaaataggttgcttagcttattattgccaaatatttatttattaagagggtttaccactaactcaatctagatgttttctacatattctgtctggtcttgttacagcttagtagttaattgtgcggtggtgtttctctgggctccagctactctggactacaggttttctttgttgttgtgaaaatttattttactagtttcagttggagtaaatgaaaaagatctggcaatggatggtggagacggttgtacaacagtgtaaatgtacttaatgccacagaactgtatacttaaaaatggctaaaaggaccaattttatgttaggtatttttaccatgatcaaaaacaaatttcagtgcattttattaaatgtgattaggtatcctggtttggattctggaacagaaaaagggcattagtataaaaactggtaaaatctgccaagcacagtggcttgcacctgtaatcctggcaattcaggaggttgagacaggaatatcacttgaggccaggtgtttgagaccagcctgggcaatgtactggcatgtctcttaaaaaaaaaaaaaaaaaaaactggtgaaatctgaacaaaatatggagttttgttaatagtatctaccaatgttaatttgctagttttgatgaatgtacaatagttacataagatgttaacattagtaaaaccaggtgatggggttaggggtgtactggaactctctgctatctttgaacttttctataaatctaatattattccaaaatagaaagtttttttaagaaaatggattctattttgacccatcattttggaaaggaggtagaaaggaccattagaataatctggcagaagaccaagaggtagaacccttttcttctccagagcttccaggttcagctccttagaaatgatggtagctaaggtgcagtagagcacccctcaccaagctatgctactctgaaaacagctcagtcagaacactttttgttcagggctatatatatatatatatatatatttactattatatattatattattatgtatatttattatatatgaataatatataagattatatataatatatgaatcataatagcactatttcctggatggcagttcagcatagtgattaaaagtacacaatctgcaatcagactgcctgggtttaaatggtatttctaccactttccaactgtatgattgtgaatagttatttaacttctctttgcttcatttccctcatacataaaatggcaatgataatagtacctacttcataagcttttctgagcattctatggtaccatctttatgagatgcttagcacaggcctgagttagagtaagtgtaggtattattattatgtgtcaggcattatattaagtgttttatatacatttatattacttgtgaactgctataatgtctcattttacattttttataacttctaaattatatgatatttataggggcccaaatcataagcgtaaagttaacatacccaagtacccaccatccagatccaagatacagaacattatcatcaccccaaaatttcctatatgcccccacccagttattacccaccaaaattaactccatttgtttctgtttctattcagtttcagagatacttccccctccatttttcataagttaatttggggattgtagaaaacattagcatgattcaaaatgcaaaaccatagttagtaatgtttttcctctcccctctgtttcctccaatatttaatttgaagcactatggctaatttatttttaaatgagagtcatgtgacatttttgtcagaaaattgcatgaacagtaattttcaaagcattctgaagtgcttcacagcccccttcattcagttcaaccaatattgagtgagcacttaatttggcaaagcacagtagtggaaagaaaggtgaaccaaacaaaggcttgtctttagatgctccaagcccaatttgggaaaaaggcccttagacatagaattctagtccaaagcacactctgaatatgataatagaaatgcgaagttctacatgtaaaattaccatttacaataacaacagaaaaggaaacctgtaacatatcttttttattagtaatttacctgacaaaaagtatattggacattttatagataaaaattttaaattctacaaacagatgtaatagatctgaatcaatggtgggatatacaacgttaatggatgagatgacttactgtaaagatgtcaatttttcccaaatctacaaattcaatgccattcttttttgttgttgttgttgttgttttgtttttgttttgagacagagcctcactctattgcccatgctggagttcattggcgcaatcttggctcactgcagcctctgcctcccgggttcaaatgattctcttgcctcagtctcccgagtagctgggattataggtgcccaccaccacgcccaactaattcttgtatttttagtagagacgaggtttcaccatgttggccaggctggtctcaaactcctgacctcaagtgatctgcccacctcagcctcctaaagtactgggattacaggtgtgagccaccacacccagccaaattcaatgccattctaatgaaaataccagcaggatattttaaggaactttaaaaacttattctaaaatgtagatagaagaataaatgtctatgaatatttaaattgatttttgaataaagaacaggtgactttcccctctacaatttgagaaatgctgcaaagacatattattattagtaataagtaggagtgcacagtaaaaggccagtaaaccaattaatagaatatagagctcagaaacagatgatgagataaaagtaattttacatcaagggaaggatggatttttggtattggaatgggtagatcatcatgtgacagagcttccaaaccagtgtgtcacattacaagctataaatggactataggtttacagagctattgatcttcttgacccttaggatatccaggaagaacctaacgtggccagagctcccaggctggtggcttccacgggtgactatgagcagtcctaccaatttaccacattatgctaagcatatgctatcatatcctcttggttcgattacctgaaaaagaaaagaaaagcactgttatctggagaaaaatagagttggattgctaccctatatcacatacaaaggtgacctctggatagattacaaacctaaatgtgaaaggtaaaactgtaaatgtaggagaatttctctataacctgaaatagtgtagaacttcttaaataagaccccaaaccacaagacataaggtggaaagtcataaattttactacatcaattttgagacttccggttcaatgaatgacactatagacaaaggtaacagacagatgatagactgggagaaggtatttgcaatgtctaaaactgataaggcattgatagctacaatgtccaaggaactctggtaaatcgacaagaaaaaggcagaagacacaattgttaaaatgggaaaagcatattcacagaatggacagaccacagaaggggagaaactgcattggctaacaagcctatgaagagatgattagccttgctagtattcagagacgtgcaaattaaaataacagtgagatatcaagttatacttatcagattgacaaaaattttaaagtcagataacaccaagtgtttgttagcatgaggagaaaaaatgatttttcatgtattgctgatggaagtgtaaactgttacagcttacaatctgacagcactcattggtattaaccatgtattcctatacccagaaacctcagtgctgcatatatatcctgcagaacctctccatggtttgaaaataggacacttacggggatgtttttcacagaatcatttgtttatcacagaattttttgtgtaagggattagaggcaaactagatgtctatccatagagagatgtacatgtaaaatgtggtaaatgcatacttttgaatattacataagggttagaagcaacaaagtagttgtgcaaatagtaatatagatcttgaagacattcttgagcaagaatgagaaatagaatgtgatctataacccaaagacagcaatatcaatttaaaatacacacacacgcccgggtgtggtgactcacgcctgtaatcccagcactttgggaggccaaggtgggtggatcacgaggtcaggagttcaagaccaacctggcgaagatggtgaaacccccccatctctactaaaaatacaaaaattagctgggtatggtggtaggcgcctataatcccagctactctggaggctgaggcagagaattgattgaacctgggagctggaggttgcagtgagccgagatcatgccactgcactccagcctgggtgacagagcaagactccatctcaaaaaaaaaaaacacacacacacacacacccaaaaccagatagatagatagatagatagatagatagatagatagatagatagatagatatagagaggtgataggtagatgacagatagatagagacacatagagatagaagatagacagatgatagataacagagacacatcgagattgatgatagagatagattttagatagataaatgatacatagatagatagatagatagatagatagatagatagatagatagatagatgatagagacagagggagagagggaaagagaaagggagagatagttgttagatatcctggactcatatcaaatatattaaagaagatacctgagagggatagaaatgagaatggggatgtggatgaaggaaaagatcttttcaaaatgaggagctggacatggactaatgatgacattttattataaactaatagatgtaattaacttggctctttatagctgagtcattcccccaaaatttttaagtgattttggaagggagacatcaactccaaccagggaaatctgagaagtctgtttggaagagggcagatttgagctgagctttgaaagatggatagagccttggtagaaagttctggaagagaagggtatttttggtgaggaagcaacttggttggaagccacgtggtgagagagtacaagatgggtttaagtatcagcaaggagattgtaatttttgaagtctagggcaggtaggggtgttttgcggaaaataagcctgcaaagacaggtgggagttgaacggtgaagggctttcaatgtgtgattaaggagtgtggattttattttgaaagtaatatggagtggtttacaatttttgagcaggagagcaataggaccagacctaggacaattactgtcacagagtgttagatagattgctgcaatgtttgactggacacagagataactccagaggctgttgtcattatccaggtgagagctaatgagggactgagctaggttttggttattggttcctaaagggtctaataagagtggcatggcaggacctgagaaataaattagaatgctgtctcatctttatagcaaaggtggtggaaattgtaggagatgaatgaagtcaccatgagagagacaagagcctttgggcaaaatggaaggggccagtgaagacgatgatgaagggacaaaggactgaagagcccatagtatagtgcagtgaaagccaaggagggggtttcagaagggaaaagagtgttcggtgatgacaaatgctgcagaggtctatgggattagaatttaacagaggtcactggttactttccagagagtactctcaagagagaggagttggtaggcccagattgccagggattggagagagtgaaaggagaggaaatggatgcagtgagtgttggctggtttaccatgaagtttgttctggaaaggcaatggagagatgggatcgtagcttacagggaacgggagtaagggagtcagaggaagcatttttgtttgttttattggttagtatcaggcactccagagcatgtttcgaagatgaaaggaaagcaaccagtccagaatagttactggagtagggtcccaagggctaggatccctggagcagctacctggcagtgctcactgcaagctagccttgctgtatcttggtgtgcaccttccccctaattgtgctctttagctttgcctttgggagatctttcctcttgcagatacacttactagagcttctcccacccccgtaacaacccctcactttttcttctcttgggttccggagactggttgaaactggactaacaaagatacctgcctttgtcaagtctgcaagtcaagggatgtgattagctgcttggttctcaggccaaaggacctgaagcactcaaagccctgaaggggaaagtacttgaagatttgttttccactcagctttaagggacaagtgttgctactgttggccgtggcaggcttcataggggactttatctctacagaattctgtattaactttttctgaaagattgccagcacccgattcaaaagcttttaaaatcctcataaaactagagaatgaaaaaaagcaataatggaggtggaaggtaagcagaacatgggacttcctgcccagttcaccatccggccaggcccctggtctggccaactccttttcacctctttttctcccccagatcgtaggatttagcctgttttgcttgcttttctgactgccacttcccccctcctcgatttcccatctagatacctttagggatggtttcctgatttatccctagctctgctttctctaagaaccagataatggactgttaatttgtttaaagtgttttcattgctacaaactctaaggaaacagttgggcagagtgagatataaccaaaagtagatgacggtgtgaaagttgggaaggtacagaggatgaagaaccctgacaaaacatgagtctttagtgagctgtgaacacatgagctgcctactctcctccctatacaggccatagactctggcctgggagttagcaccattatctccccagcagctgaaaccatctctctttgagttaaatgctagacaaggtcttcagcctgaggtagatgtggggtgaggttgctaacagtctagtggatttttcccacatgtgaatcctcaggttgctctctctgactccagatttgtcttgacagaacaggctcaagtactaaatgttgtacataatttatacctctaggtggttcaagcatctcactttgagcaagggcaaattttcttataaatcattgtttaccaggaattgctggctcccctctggctctctctccagtctggagcccaagatcagctatttccacattgttcttaccttcctcctattggacttatccctctccctcacctgcatcctcagccccagtacttctgatatatttgccagtgcccagacctggaaaaccccaccacctgctttgcttcctcctgctcctaagctgccaactattgtttgaggaagtttcctccacacataaaaacatgttctctagtgtcgggggagctctcagtgctgattggtaggccttcacacttttctaacaattgacatcctgccacatcctccatagcatctccttctggccctccccagtcatcctcgacctcaaatacctcccctctctactcatgacctcacttcctacatttgttgagaaaattgagatcaatttgaaatagacattctccacttccctcttacttaccaaaatgtgtcctgggtctttttctttatacatcttctactctctagtttggaagaataaaaagccctcctctatctccaagataaacccatcaacagtccttgggttgagaatcatatccctcctgcctttctatgccttatggtatatactcatgtgcatgcataacttctcttttctaacttggattgagagttcctcaaggacaaggcccatgttgcattcatttctgtgtttccagcatgttgcaccatggcatagtcagcaatcaacaaattgcctgatttatctctaaaaaattgcctcatcgatttactgaaccgatgagttgtcagtggaacaagtagactgatttgagttctttgtcctttgtgcatctacgtaattgattgctaagggtgccactgggcagcaagaagaattcagggaagagtcaagaggattcaatacactccagacccagggtttttggtggagttacatgacattttatctggaatttttgaccaagaattgacctatcactttattaagggaatagttggaaaagctgctagactcagactaaagatcttgctctgctgcccataaactgcatggccatggacaagttaacccctgggtctcaattactttctctagtacattgaggacagtgttgttatgagcattagatggagtcatacatgtgaaaacactttgaaatctgaagcacttcaccaacgtaaacttgtaactcttagacctgatgccaccaacagctctagagcttctactctaacaataccacagctgccaccacctccactgcccatctttcctgttgcacacagaacttgatctcatctcagcttccaactgtccatgatggaaagggaaaatatatcacaaatgtggagatctcattcccttcccatctttttgcctgcgtgtgtctgtgcagagggctttactagtccatagggactactatatattgatgtgagggtcaagggaagggagctgtgtcatctcatcttcttgagttcaaatccatgattgtctatgataatccatgattatatggcaggctatgccagagtaccagcaggccctaccattttagcaggctcttgtgcctgtgggcatgtgtgtttggagtggaatgtgtatccctttatcagcataggtgtgcatattaatgctcctctggttctaaatgaatacagggatgtgagtttgcatgggaacaacactgaaactatgtaagtaaattgcttccctctcttccttgcccttccatctcagagctccctgagttctctgacaaggaggtcctgacataatttctttgatcctaccctttttttactccttctatttagggaatagtagttggttgctcccagttacctctcactcccaaaacttggtggcttttcaccagagaatcagggaagtcagcattgatccagaagcaatcagctcccaccagctcagtattggaccaaaggttgtatagcatatcaatgatgggcaatatattatgtcagagaataatgccaaaagtatcccttgtctaatggaatagatacactacagcaaaaatcgctctgaagtgaatttctggcaagtcctgtttcactttgatttttattataaaaccatagctgtgttttgctagaaaaactaaaagaaaaagattggctccagattgtaattaaaccatgtatttttaaataaaccgtacatttgtaataatgtagatctaatcattttaaaactgaaatgagactcctgtgaaagacagtcaatttgctcccaactttcacagctttaaattctgctcctttttttattcaatcttttttctactgaaagctcttccttgagggtttacggcctcatgagtctagcaaatgaggtttgtttgtttgtttgtttgtttggtggacaattggagtttggttattcgagttttttctccaaaagcaaagttttgtcagtggaatgaaactatagctccttttcacaggcattgtctcaactgatgctcaaagcaacctaggaaatgggtagagcaagtaatatccccattttgctgatgagaaaacaaaggcctagagattaattaactttttcaatatcatacagctagaaggttggagcagggaattgaatctaactcttctgcttcaaacaggagacttttttaagaggcaaaggtgacatcaattcaagtttgctagaaaattttcaaatcaaaatcattctcaaattaagtatttaatgtttttccaacaggtatattagttttaggttaaattcatcccaagtaaacttgtatttattttctcatgcagtctggaaactcggtacacactggggatctttgtatagactgaatgcccattccaagtgatatgggggctcattcaaccatttataatagttacaaaggtgtttagttgttctgtttttatttttatgtccaactattgatcatatttacagttttatgtgatttttttattcttgcaattcccattaaatatcacaaaagggaagtttgatatggttcctgataatagttttatgaatgtgttatggaggaaaaggagacctgaagattcttccatgaatttatttgcctctatctaggcatctccacttcatcctattttaacaattattgacatttcccaggggtaagggaaaatatgacatgtctaaagactagttctccaatttctgctcaacctaatgaccatcaagttagcatactgtgcctatattccttctgccactaaactaatatgctagcattggagactcatagcacatcagaatttgtctaccagagcctagataaactaaccattacccactgaccaggtaagaagaccactttaattgtggaaccagaagaaatcccccatcttttaagttctagggagtgccattccttgaagtgcatcttatttcttaatttattaattatattagtacatttctattaaagagtacctattccaatgaaaagtgtgggtaaattgagataaattgctttggtatcaatgaaaataacaatattttctccgcagtgtagctcttactgctcctgttcatgggtttgtgtctctgcgttcagagcatcattcaatgcagagacagtgtagcttggtggaagaaacagaggctttgatatcagcaaattggcttcaccagttgcttgctgtgtgatctcaggcaagttccttaatctctctgtatttgagtttcctcatctgtaaaatgagattaatacccacctgttggggctgttaaaagaatagaggaggtgaatttaaggaatagcactttataaactcttggtaaaagaaagttattattatgttttagaagagaaatatcagtaaacaggtagaagaaatggatgcaaagtcttgcctagcaagagttaactttatcagtcgggatatgtcttccaaaaaatttcaacatgctgacaataaccagtggaatgggtgtatgtatctttgaaaacaaaacgtgtagatgcatgtcttcatgcctgggctggctgcttcaaacgctgattatagatgaagaactagaaaagaaatgtgattccatttgagtgttgagggggagactctgatactatttattagctgtggcagacctgaaaattgcctttgcaagacatcagtcactatgtatgtatgtatgtatgtatgtatgtatgtatgtatgtatgtagatggaaagggtcactgctcttgttggtaaattgtaggtgatgttaacattatcaagctgatccaaaacttcttgggccacaaaataggtctctatatctgcatgatatgagtctttacctgccatatgctagacacattcttcaccaccagcattctttcttttttatttacttctgcaggcaatgctagttcattagtgctgttactaggagagtgaagtgtatggctctatggatactcatctccatttgtttcaacagagagagcacagagttgactgggaggctctgatgtaactcttccactgtgcagctgtgtgacattagccagcctattggctaactgctttgcagcttggtgcccttcgcctgccttgcagatgtattgtgatgatccaaaggaatggtgaaaagaaaactgctgtgaagtttaagtattctactcatgggggtgttattattagtatctttcttaccacatttcattgctaggagaaagatccctggctactgaggtaaagtttgttaagttcttgcatttccccccaaccatcagctgaaatgagaatttcagttgtaaagcaaagacaaattgtaaaaatcaagccaccttgtttctaggctggaggtcaaggatctctgctcccccttctcaaaaggccacaaggagttttttaggatagtgacattcttttaattccattttgctcctagcaaatgagacttggaagtggccttctcaaagattccccagtgcatatttaattctctattttcattcatttcataattatgcattttccccacaattatgttttgtgtgtctactgcacaccaaatactgcatctccggggatatggtggtgaacaaacctcactctgtttcctcaaatcttcctgttttgtgggaaaaatgtgctaaacatctccctagatgtttgcccaggcatcttaaattccacctgtccaaaggtgaattcctcatcttccacccaagactcttcttcctctaagttctctcatgtcatcaaagagatccactcggttgcccaatcaagaaacattggagtcatcatttgcactttcctctgttttgctcatcagttccaatatggcactaaatccttatagtttttagcctctgaaatatctctcaactatgtcttttccctgtctccactgccatgaacctagtccatgtcaccattatttctcttcaggaggtcatagacccctcatggggttccctgtctccagtcttgctactccatccactcctttcctcttgtggtgtgtcataatgaggaagaaggagaggtgccctaagtcatagtgataaaggaatgctgagggcctttcagagattgtgaactccaaacctgcacaagccataatcatttgctgaataataatacatcaataacaacaaataacttttattgcacatttaatatatgcaaggtgcaatgctaaatgatttacaacagggattctccaagtgtggtctttgatcctgtagagtcagtaccacctgagaacttgttagaaatgcagatttttagacccagccggcactactgaatctgaaactccggagctgaagcccagcaatctgtgttttaatcacctctgcgtaagtctgatgcatgctaaggagcgaaaataatgatctactcgaattttcttacttagtcttcataattaccctatgaagtagacactgatattatcctcacttgacagctgaagaaatttgaagatgccatttgtcccaaagtcctacggtggtgaagagggaatttgaatcctagacttctgaactctgaaccctgtacacttagctagcatatcatctcacttcactaaattctgaaccaaactggaagccaaactaaagtttaaaacaaaacatgctaatgtaccagattaaacacctcagcatctgtaaatttttgtaggttattctctattgccctttcttactgattctctgtgatctcacctctgctccagccagacccaggcttctgactggccctcgcttacagaattcgctgattcccatcaacatgttgttcttcatgtttagaatgcattcactaacagtttgttgggtctttctttgcccctctgctcccttgtcaattcacacgtctctgaattcctcttggacttgtggtatatacagtataattttaaaaatgcattgcatatgactggtatggtttggctatattcccacccaaatctcatcttgaactgtagttcccgtaatccccacatgtcgtgggagggacccaatgggaggtaattgaatcacggggctggttacctccatgctgttttcttgatagtgagtgagttctcatgagatatgatggttttataaggggcttcccccacccttcactctgtacctctctttgctgccaccatgtgaaggacatgtttgcttccccttctgccatgattataagtttcctgaggcctctccagccatgctgaactgtgagtcaattaaatctctttcctttaatgcaatgaccttatctccaatactttttgtgatatggccttatctcccccaacaagcttaaatgttccttgagggcatgggccatgcagtgtgtttcttttgtgtattgccttctcagcccctacatgtatattcatacttgccaagcacaaaactcagcatgagatgaaaagtgtttaattaggttggtgatgggccatgcatcatctgttttcaagggataacataactataagtttcatgaatgcagaaactatgttttacctgccatcttaacctctgtgcctggcacagagtaagtgctgaataaatcattgttgaatggatgaattccattcaggatgagaatcaaagccatttcactcagagatctcagagaacaaagaatgcccagaaactacattagatgtagaccatttctgttttcaaaggctctaaaaggtattgttttaaaagtctacagtggatgttgtatgaacttgggtaagtcccattctctttctgcccttcaacttctccatcctgaactggatcaattcctgagtcttatgcagctttcttttcagtgattctgtgatcagatgtttcctgattgcactctattgcaactatcataaattaaagttaaaattctaaggtccccccaaccatctgaatggatccgtcctcttggctaggggctttccaaagctaacctggaaaactagttcagtccatgttaggaacaaggaaccagacatgcctcattatactctcctcccttttggagttactgatagaacagactctttacgtctgagaagaaacatttaccatctattctctccgaagcctgctacctggtggcttcatctattatgatatatccttggtttccacaaccccttattataacccagacattctcttctattgataataactctttcgacaaattggtaatcagaaaatctttgattccacctatgacttgaaagcccccccaccctgccccaggcttccagttgtcccagctttccagactgaaccaatgtacatcttacatgtgttgattgatatctcatgtctccctaaaatgtacaaaaccaagttgtggcctgaccaccttggccacatgttctcaggatctcccaagggctgtttcatgggccattagtcactcatatttggctcagaataaatctcttcaaatattttacagagtttgactttttcctcaacactatttagacttccaaacaagatactgctgtacctgggccactggcttctcagtcatttctcaatcatttctccactcagcaaacatttactgatgcccactgtgtaccaggcatagtgctgagcacaggtgattcagtaaagagtaagacataagccctgtcctcaaggagttcagtctgttgggaggtatagacacataaacaggcaacctagcccacacattgggtgggggtaatcatagaaagctccctggagaagctgatatcttggttagagcccaaaagatacagaagtggtagccaggagagcagagccatatacaaaagcacataaaaaggccctggagtaggaggttaggagagagtaacgcaagattggaggtcacagaccatttggcagactgtggcaacactccaggcgagagatgagaaagacttgaactaagaccatggggctagagatcaatgaacaggtttcagttagattttggaggtagaattcacagtccttgctaatggatcggatgtgggagatgagggaatggaagggtcatggaggacccctgagtttctggcttcatcaactttatgaatggtgccatttactgagttaactcagaaaaagggagctggtttggagaatggggttgaggagaagccaatgtggttcagtttggggcatgttgggtttgagttggaatatttatttgaatagatctcttatacgtcattgactataaggatctggcacaatcagaagagaaatctgggctggaggttcaggtttgggagtcattagtatgtagattaaagcccttcaggaggaaaaataaacactgagaagccaagtaccaaggagaaccaggacaccattgctatgtaaaaggagaaatgctctcacagatgtggggtactggcatacatgctcatctattcccaagcacacatctctgcccccaaagagggtcgctcaatgatgtctgtgcatctccaactgaaacttaagagaaggagcattggtgcccaatcctaaactctccattttgccataaatgatgcctaaaggaaaaagggaactaatgctttcattctatctgccaggtgttttatatgtattaactcatttaaatgctgacaataatccaacgtaagagctattattacacttcagcccttgatactcaagatggttatatcccttgcccaaggtcacataacttaattggcagtaaggagacttcatttaaagtgtacctaacagcactgcatcaccttctacaatacaactggatccttaggaaggcctgtgcacacccttctcccttccctgcttcataaataccatttgcatcccctagcttaatgctttgctttacaaatccctctgggaaaagcaaagctctaagttgtcagtcattaacgcctcagtgggaatgagtttcagattcttcctcaggaacaaatgttaattttatgggagaagaacactggaaccttaacggaggtataaaaaggcagaaagggactaagttatgaaaagtcagccccctccaccagtttcaccgtcctgtctagtgtgaggcatatgcttttaagattcttcgatgatatatctacatatgtctactactttataggcagccccatttctgggtcttttaccctagttatctgggtctgatcagaggccaccttaaacttcacactgatcccaactcactgtggttggcaggaggcagccagcctgggctgtggttgcagacctgcggttcctggccttaagcacaagtcccaactcattcccttgagaattagaccctgatgtgcatatttaaaatcctgagcagatggaagcaggagagctcattggaaagacttggaggagttccttctgccctgtctgggtctatttgccaaaataaatgacatgtatcagaacagggcattagtccaagcccattgaaattctgctagctgtccaaacagtgatggtgtttcagattggttctgtgaaatgatcagggttaggaaaaaagaaataatgtgtgagcatctggctgctgcagcctactgatggggacagtcccaggggcgggcccagggtagtggaggggcagcctcaaggaccccctaagacatctgccactggcaaacagggaaacagccacatactggcagcaggtggtctgtttagttccatgccgttcctactagctacgtgacctaaacaagtccttcctcttctctcggccttcccccttccccccgccccccgccccatgtataaaataaagcccggattgaatggtctctaagggcctttcctgctcgaacattctgtgacttctctgacactggtttgatttctttttctctgtagagggagaggcccacctacccacctgcttatctgtagtctctatgttctcacactgacctctgctggccattatgaaaaatgtcgctgatagtgtcggggtgggaaaggaaaggaattcaccactgatttagttaatattaagctttagctgtatgggtaatgaggcagaaatcctgtgcattagagatgaggaaaaaagatcatacagctataagcacaaagtaagcgtatctggatgacaaaacaacccgcagaagaaatgggtctgcctcttttttttctcagtcaccttcatttgttcccggtgttctgtgccagtgtatgaaaggacatccatggatgggaaggctttttgtctcatatcctatgactgcaggctccataagagcctcacaccatgctgaggggacagttctggatgagcagaagcctagaaacttcccacaggccctgcttctggcccttgattcaatgtgagaggtttcaaactgagctgctggcacgcccgccaacccaagctggaacctggggccagtccagaagtgcatgttcctctagggggtgccttttcaaacttctatttggaaaaagaattagaatttaaaaaatatatgtgagttctttaggagagttcctttcagctctcttgttggaacacaggggtcaagaaattctgcatgcccaccaagccaggagaaaggaagcaggctgtgggaccctgtcttttctacatggaatcagagttccagttaggcccagccctcgagttgcctacctcctaagtctccttgcttacccttgctgataagcatgtgcttgcaaaggtaagagaccagaggtagagggtgccagtccctgtgcctatgctgggtgctgctgggactcttctctctaatggtgtgagcaggatgggactgggccacatcacaacctgctctctcagtagctgttcagtgatttactgtcctcttccccttccttcccttgatgtgggaaaacttttgtcagggcttggatttgggtcaagcattcagtgccctgactggatcctctctgctagtaataacatggcctctgcaagcccatcctgccctccattctcccatcaagcagctccctcctcctcaacagctgcttcttatctgcctcccttgtcccagcctcaggcaggcagccctggcctcattctgacatacacatgttatcctgaatgcttcttgatgactttcagccctgaaagaccgctcttctcccaactctcccctgttcccaaacctctgagggttccctgtgtcctgccacatcacgacttcgacttttctgcggtgctttccaggcccgcttcagctggaacctttccaatcaacctttccagtgcggcccatgacttcccccagccatgggcaaaatgtaagccttccacaaaccctccattgccaactcttttttcatgttcccacagcacttaggctctgttccaaatttgtactgtttgctgtgattttgtatgcattagtcttgaaacctaggcccacattttctttctttttttaaaaaaattatacttcaagttctaggatacatgtgcagaacgtgcaggtttgttacacaggtatacatatgccatggtggtttgctgcacccattaacccgtcatttacattaggtatttctcccagtgctatccctccccttgcccaccacccctcaacaggcccgcatgtgtgatgttcccctccctgtgcccatatgttgtcattgttcaactcccacgtatgagtgagaacatgcagcgtttggttttctgttcctgtgttagttttctgagaatgatggtttccagcttcatccatgtccctgcaaaggatgtgaactcatttttcttatagctgcatagtattccatggtgtatatgtgccacattttctttatccagtctatcattgatgtaggcccatgctttcgacctcctactcattgtcaacagcaccccagcactattttttaagtactgctctttttatattattaatatgcattatacacacatatacatatatacacacatatttattgattttgtgaaaatcccaataataataaataacagaaccactgtaaacaaagttccaacaatgggaggtaggagcctaaaaattgaaagtttactccacccccatcattcccagaatgaagcctgttaaacagtttgcaacctatcattttttgtaggccacatgttgggtattggaaaaggttaagtggtaggtggtgcccaagagaactgcatttccttggacagagcatcttttacttccttgcaagggtcgtaggtcttcgtgggcctgattgacactcaaaattatactccaaaggatcatcacagctggtggccacttgcatctccagtacttaactgtagccacagcataaggcatctgtcccattttcagccttttaaaaagtaagccttgaaggtgaacagtaaagggcatgcttaatgggcttcttttcaaagtttttcacagatttgtaggaaatgatggacagtcagtaaaggggccaagaggtggagatgggaagcatttatgaaaatggactttctacctgatacggtgttgtgctctctgagaggtaatgcatattactaatggttttcatttttctgccaagaaaattcagtccctactgggatttgttctaaatgatagaccagcctgcctgtgttgcacccactagggttaatactcagtctgagtccactttaaaatgtcagcctgaactctcagacttaattgttacagacattttataagcagggcatttaaaatcctcaggctgttccctcttgctatcataattgatacttaatagatattcttaggcttcttgtattttacacattcaacactttacagattggagaggagaggagagagggataggaagaaagaacaaataagcaattcatgtgtgtatatgtgcatgtgtatgtgtgttttccctgtgaatgtctgctactaggtgcagtgatggagtcctgggatctgccaacgaagatgagctcttgcaggtttgtcagcctgtaggtttctgggcccactctggccccctggggcaatgttctttagccacagccatttctggatttcactgcaagcacatggttggccatttggacgtgagttataaaatgtcatgatgctctccagcgctctgttctttcactattttgacaatctgatggatggcctggcattaactaggaagaggacaatattatccatcctgaataactgatttcctaagaagtacaaagttgaaggatcttggtgcacatgaatcttattaaatgtgcttataaaatgtgttctatccaaataagcttagcaatccctaaaatagccttttctgatccgtgtctggaactttggcgtgcctcacagatctcttagccaaaattattcagtgaagttatgacagtgctctttgtgcgtgggaaaatgagaagtattaatgctaagtcctctattgactaattgcactccttctgtccaccttagggacgacctggaccaattggaattcaaggcccaacaggtcctcaaggattcactggctctactggtttatcgggattgaaaggagaaaggggtttcccaggccttctgggaccttatggaccaaaaggagataaggtaagaccagcaaagcttgatttctctttgatgcatgggccacaaatgtaaagatcagaagttctccatcccagttctgctcatttatgatgtcattcctgagtagtttggtgccaggctgcatttctgcatttttttttttgagacagagtctcgccctgttgcccaggctggagtacaatggcgtgatctcggctcactgcaacctctgcttcttgggttcaaatgattctcctgcctccaccttccaagtagctgggattacaggtgcctgccaccagctaatttttgtatttttagtagagatggagtttcaccatgttggccaggctggcctcaaactcctgatccaccagtctcagcctcccaaagtgctgggattacaggcatgggccaccatgccccacccaggctgcatattttaataagagatgggatgggtgatggcctgccaatggatcagcccacttctggaaggactcccatagcaagcacaccataaagtaaatgtattagctgcttgctaaacaagtgggctcactgtggtaagaagtcaggtgggtttgaactgtacatggaccggaagtccaatcacctgggcagcacagatcaggaatccaagcaaggatacagggaagaaaggggtcagagtgcttagaagcaatctaggccacaaatatagggaaagagctgcaagaaacgagagtgataatgtcatggtggcaggctgactgttcagcagctcagtttatgttccctgcctactttaatcaccttctattcgccctgttggtgagggaacgattccctcactaggatcatggggatgactaaagatatgacacctgacactgggcagatgaagttgacagcaatttattagtcacatatactcacagctcaggggaggaagataccacacaccacatagggccacatagggatagcacttgggaacagagtttagaagaaaaggctgtgcaaagcagactttgtagtatcagtagggcagggtgcccctggttcctgaaggtggatgcaattggcttgtttgaatagtccagtaggccagcaagaaattgaaactgctattccaggataagcaggaattgcacctggtccatttgataaggagagttgttcggctaggggaccttatctgtagaagcataatggagagggaaacttgtgattaggtcattcaaggttctccagttttccccagatggcagcaggtaatagtaagccttaattttaaaacctcgactatactcccttaaaaaaaagagctggtttcggaacaaagacctgtctaaggccttaggtagaggtaaatggtcacttcgaactgcagtaggaatcaagggaatacaatatggggaggggggtacgaaacacttcttaaaaatgtaggccattgactctcataaacctactgagtctaacaaacatcagttggattgtgtcttacattcctctccctactcctttttttagggtcccatgggagttcctggctttcttggcatcaatgggattccggtgagtgtgtccacagatgaatttttcatatcctcctttaggttctgcctcatattttggacactttgacctcagcaacatcctgtctcatgcaagcatgctcaggaacaagtgttgagatatgtatggtgaggtttaaagggcagtggtcacacacaattgcccttggattcaggcacaagcagccctatgtcggatgattggagagcggagggacctgtgtagccataacatcaatatcttagccaacatgagttaagtcttgtgggttgagtggagctttgattggagatgaggaactggttctaaggtgtaaagacagagccacattagaggatatatatcctcatatagggaaattaagatggtacatgaaattagagggtaaaatccttcatgatatcttgatacattccattttgtaatttgttctcttcagacatacctcatttcagagtgaattttcctttaaagtttttacaaagtgactactccaaagatcacttggaggcagcctcttgcaaaatttgtcctgtggacctctgctctgcccaagagaagtggaaggtttggaacttgcagacatttcttttttccatccacccagcctaatcccttagtttctctattttcatcctgtatctgtgcctatcccaccactggtgattccatggtagcattgcaccagcctttaaaatacaatatttggaacttactggctatctttttttagtttttccctttgacacttctctatatatttaagccatagtctgggctatgtttgtctacagcagcagttttcaatcttgtttaatagaagaacagaatctcagcatatagaacagaaaaaaacagtgcagctcctccatttgtgggaggtcctagagcctgcttttatccttccaacagcctctcagagattgttctgaaccttatcaaagcatggtttttggaggccctataattaacagcttttgtgttatactcaataataatctaatgtcaggaaaaggggttcaaatctctttttgccaatctatagatatttaacgtgcccctgctgtatgttagcactcaaccttgggtatacagaggaatcatgtggctctgccctgaaagatagtatcatctgattcattgtctcctctgatgtagtagaaatttatgaatttgaagaactgaaggctcacttacctcgtatctgttgcatgtatcaacaaatcggccatcagacttcagcattttattcaactgcagagtctgcaaaaatgcccagaaatagaccagtgggaaaataagcggacagggttggccatccttttgtgatgtctcctgacattttcttatggctgtgttcctatgcccctttagccagagtctccacccagactgtgtatcttctgggagccactgggtaagggaaactagcaaactggaggcagcctcttccattcatcctgtggacctggctttgccagagatgagtggaggacttggagctttccgtcttagtatgcccttcctcctgcagtcttgttttaatgggagctggaaggaagtgaatcctgtgaggctaaggctgtttccaattctgagctggaaacggccccagagtccagctggatactcttgcctccaacctgtggccaagagagccctagagcttgcaggagttgatcacttctcttcgaggcttcattgcttggcagaatgagttgcagctgttcagacccctcttaatgagcttactgctcccagtagaagtccccactccctgtggggtatccacatcttttacttaggccttatccttttctagttttcttgcctgaactcctgatatttcctttccttgaccaaaaattgtatgtgttttcttttgacttctgattgccctagctgcaggctccaaacctcattactccataaaatcccactttcttgttgtttctctctcttgaagcctctcaagaagtatttgttgaacatcttctgttcagtgcttacctcttccttccatttctaatctcccaggagtcattggtacccgtctcaaatactccagtgcctcactacctacagcctacagccctatgggacttagtgatagatagttttttgtgatagtctcatccagctcctagaaagcagagattatatcttccgttcctctcagaagcctgagaggcccatgaccaaactctgcatagagtaaacactctaaagatattgcggtggaggctgactccaacctctagtgcctagcaatagttcttagactgtcagggctcccccagacagaaaaacacagacaccataggcctagtcagactgattattttgttcaactttcagtaacacatattaagcaatttggctgaaaccaacagctttcccaacacatcttactaaactggatcactgcacagatctgcttcccctcttaatattagctgattgttaacatatgtgtcactagctttgttctcaaaactccatttttgctgtcatgtagacaatctcaacatgagtgggttagtcgtcacttcatgataacctaagtctttgcactaaagggcacagcaactaatcaagagagtgagcaaacaagcattcctaagatagtcaacattagaacaacatagactagggacagtagggctgtggcttttaatgatatcccagctgtgagttgggcctgttggcatccacaagaaatgtgtgtttatcaaatgttttcagttcaaggcagttgggagcagagattttcactttgcaatttatgtttagctttccccatggagtcaatcctgaatctctagttccctgcctggagacttgtaaatgagcacatgagatttatatcctcaaagtgaacacacaccactcaccaaatggaaacttttcctttgaaactgggttctgaggaacattgctttagcttttctggaatacaacagatcctcctattccatgtgctcagtcccttgaggcaatatagaactgtggtttcccccctcaaagagctatacgctcttggagggttggcacacacatatgtaaaatcattagctataagaatgaagggcaatgtgccagaaattctgtggttctgagaactgagaggaggtagagctcagtcctgtggtttacccttgctgacttgactgagagaagaccatttattgagctcctacttagtaaacctagtctcacttattttaaccataacccagtggaataggcattattcacttttaatgctgacaatgactctataaggtaggtattagtcatcaccatttgacagatgagggaactgaggctcaagctggggaagggaaacagtgggattggagcacaagtctaactggctcaaaacatgccttgtctacccattccttggtatcagctggatgaaaaggggctgatagatctgagtcagaggtcaaagatttatttccagagaattcagctaaggtaggaaagtgtaaacaggtatccctgaaatcctacaggtaggaaatatcaggagttcaggcaagaaaactagaaaaggataaggcctaagtaaaagatgtggataccaaaggttaagaatccagacaaaggttttggtgtcaaacagaaacaagggctcaggagtgaggaagactcctggcactgagccagcctgttgttttgcatcaatttatccctgtaacctagctgagagataacccctagcaagtttggctgggacattttataatagtggtgatcaggatcccagcaggaaacagacatttcacctgaagagtttaactgaatagagttgagtgaaggctatatttaacagatgtgggaaagattaagggaaacaacaatggatggtggaacgactaactcaaagctacccctagacccgaaaggggaaaaaatggaatggtaattactggagtcctctgagatctggaaccatgaaaaagctgttgccgaataggaactaagactatggaaaaatttgtccatttccttggaatatagccaaggagggagggcatgggagaaataaataacctgtgtctttctcgtcctgctttgatctctccagtctgtgtctcccagtggccaaatacaactggaagacagaacgaaagggagcctaggttgcctccatagaggccaggctcctaggacatagatctgagggagatagagtgtagatcttcagggcaaacaagagtaaccatcccagttactaataaaaagttgcaaactttagtgagctgcatcagcttccccagtgcaactaaaaatcatcacctgagtctgcagaggcacagattgcagcaactttgttgtaaagacaagtttattgaccattcctctggacttcgcattccatgagtccagtagtctagactcacacttttgtattaacagtgtgtctagctcttacaactataataacaacgaaaatgaaacagaattctatagaatattttctctataagaatttgataaaaggttgtttcctctaataatttgaaaagttcatttttgaacatatagcatgtttctctcaaatcattaaatatatatacttggcttttaaagtgtgtttgcatcggcaggggggacatctaccttttattgacctgtctatatttctggtctttctggtcatctctttgctccatgcccaacacacaattggcttttgatgaattaaaaaaggtatattatctacaaaagggtagactctatgtaccaaggaagcccaactctggaaaattattgaattcagatgaattgtatgagaatgattactaattccccagcaaaacaactgcctcagtcgttagtacggagaggaaaacatacagttttctaactgaagcaatagcctgatgtgtgagcatgataaaatgagattgaaaatgtgattcttgcaggacttgcttattttggaccaagcaactttcaggagagggggtgctgtgggaactgcttctgctctgttaaccaaaatccagcatcatttcccatgcagagcttccaatactgaatgtcatgccaggctgctcaggttctgtctggcctgaggaatcccaaggcctggcatgattccctgttggtatcacttcagctgccagacagctaagcccaattttagtacatctttgtatacaaggaaggtaaagttgcaagaccttgtgtatcccatctgttcatgcttgatccctttggtttcagcttggtccctattaaagcattcatccttttgggaggggcaacattgagctatgattagacacatatgcttgagtataaaggaaagacatgcaaacatacatgatggggctaagggagtgaacaaggagccacagtttaatagcatgcttggcttttctcgctgtggagccatttagaatagctgacagtcctttggctaacttgatcccttcttttctctttgaacagggccaccctggacaaccaggccccagaggcccacctggtctggatggctgtaatggaactcaaggagctgttggatttccaggccctgatggctatcctgggcttctcggaccacccgtatgctgccagatatttgcattttatttcaaatggctttgcttgtctctacgtgtgccctttttctgcctctctggaaacctcaagattttgtggggcagccactacacacccttgtccaatgtaggagtcaatactggcagcaccacaacagtaaaagtctaaagaagaataccagttgcagtggggtgtgcacatgctacactgcttagggttgccttttttttaatgcagcttgtgaaattggcaagattgttaaaaggctgtagtaaatttcatggcaaaatacacacttgggctatttgacatggtcccacatcagacaatattgaggaatgtttggaagacttatatgggatcatggaagcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcatgagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaaaaacctagttctgtctcttaacttaacctcaagcctaaataggaacttgggcatgtattttactaagtggagatgtatcctttgctgaataccaaacagatcattcagttggcttttttgaagcttctttcaagacagtagtggccacaagaataaagtgaaacaggcagtgttaggaaaaaaagtgagaaaaaaaaaacggtttctgctcctgggatcacgttgttgttttatgataccaataatccctgtgctgaaggaatcaatcattcaataaatgcttcagtccacaaagcttagccctaccccacatactaatcctgacttccccttaggtgtagggacgttgattatccccaggtgtacaaactctaacagatattagccagcatctgccagtaagacagcaaaaaatctagttgaaagattggaattgtgtactttgaaccatttttcatgttagcagtgagatacaccagcctcttagacagactttgaatctgaagttgtgtggtagaagtacaggatgaaggtagttttgtagatatcttttagaccagaggtctacaaactggaccacatggcctttggcttgtggcctgttttttttttttttaaataataaaataaaaagaaagaaagaagaagagtataaaacagagtttagatatgacccaaaaggcctaaattatttactatctggttcttttcataaaattttactaacctctgtcctagacaaaggttctgtcagtgacctatacctgtgaggggtgaagcagcgaactctccattacatgagttatttgtggttgttcagaccagtactctgaatagatgtaaagtatctgactttaacacatttcagacccattcaaaccctttccctttacagacttctggcttggggattgggagggcatatagctctgaatcagagcacccggtcaaggaatgtgttttgccccttagtacagccaattttgccatagaaaaagccacatggtttcaggctcttgctgtcccatcctctatctgatcagataatgcaattaaaaagactgtaagtgtgtgtatttcttcaattttttaaactattttactcaggggcttcctggtcagaaaggatcaaaaggtgaccctgtccttgctccaggtagtttcaaaggaatgaaggtaagaacctgtaagtcagatagctgagtaggctataagctgggttccccagcattgggccccacctccagtgaaaacatttccagaactagcatctgtgtctctatttaaggagcagaccaagctggattcaaaagaatctggagctttttgtggtggaaacattgacataaatgtttgcaactatactgtcaaagagatttgctctgcaggatctagaccaaaaataggagacagatcagcaaacaaacagtttgcatgggtatcattttctttcacaaaccaagacatttcccggaggcagataccttttatctactccagaatccttgttgtctgtattccttggtttgaagccatgtatgtctctgcccatctcaacatggcctttagccaaagatcctggttctgcccttctctgtcactacacaccaacccatcaccctagctgggcccctggatgtctgcaaaaattgcccatcagccctgaggctggctggaatctttcatctctttccagaattgacaagaaccttctgtgttcttgtgactgtgttgcctgatatcctgcggggcctaagtaaaccctggctccaaatgattggccctattcccttgcagagtggggcaggagtccatcatttccctggtagcaaatgagaatgtatgtgcccaacatctgaggagaagatgcaccaagttcactcagctaattgatggcacttttctgtcttccattagtgcatagagcctggaacattggaaatcactttggaaggcagtgatgggggtgggtggctggagagccggacaagatttagggtatgggcttctaactatagatgccatagtagaagatagaatgtttgagttggaaaggacctcatgattcttggactcgtattgctcattttacagatagaaaaactgaggtgtactgaggctatgtgacttgctcaaagccagttcactaaagagctaaaactcaggcagtgctctttccatgctacagagagctgattttttactgtaagccaagtggagtaagactagcaggtgtcaaaatttggtcattgtcttagaaaacattgattaaatggctttgccaaatatcaaagagaccctggatccagtggaacacaacaattttcacaagatggttatattactgattcatgcagtaactaaacatgcagcaaagtaattaaaacataatcagagagtgtatgctctgttgattttcccttgaaatgaccgatttgcatcgtatacatatgggcacagaatctttggggatgaaggcacacaggaaggtagctttgctttcctccaaaaggagtaggaaaatcactagcccacagaagtagtttctaattgataagtacctagcaaaggtgaaaattaattaatccaagtaaaatgtgaaatcctgttcagccaaggctataatatgtgtcttctacagtccagatttttcttacagaaaaaataaacaatctaaacagtcgaatatgtccaattcatacattatttaaaacacaagactttgacagaggaggcccaaggttcagagatgtgtttttgtccctataaatgttaggttagttatctgaaatattgcaggcttaatttattaaactcttcagtgtcctgcctttgtttctcagggggatcctgggctgcctggactggatggaatcactgtaagttgttatttatgtgttgagctctcagtgttgactaaaaatcactaatggtgcattttcgttcttctctatgatgttctaaggtctttgtagacctcaaggaaaatctagacagttgaagtagaatgggtcacagtattgacattttccaaatgagaaagcactgagaggatgaactgtccactgtcaagttgcatgacaagcaggctttcagactttaggccagagacatgtattcactgggatgtactttcccctaggaatgtattttgcctttccttcagcaagcacttactaaatgttttctgtttgtcgagtgctgtgagtaaatcaaaagaagtagagcacattgctttaaaaggtattccacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatccactgtacttgctgcatagcttctcttaggtacttgttttcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggaggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggtaatggatattattgtttggatcttctatgtccttcctgactgatatttttgtctagtgtttctgttcattatggaaggagggatgttaagatgtccaactgtaattgcagatttgactgtttctacttgaagttctgttagtttttgcttcatgtaatttgaagctctgctattatgtgcataggcatctaagattgttatgtcttcttgataaattgacctattttatcattttgaaatgtccttctttatctctgataatattatttgtctcgaagcctaccttatctgatattaatataacttttgcttttttaaaaaattttttgtttttttataacattctaataggaaaaatttcaaatatagagcaaagtagagtgaattttgcaatgaacacacataccattaatattttactatacatcatcccttggtatccatgggagattggattcaggacctctcatggatacccaaatccatgaatgcacaaatccctcgtataaaatggtgtcatatttgcctgtaacctatacacatcctcccctatacttttaataatctctaagtcacttataatacctaatacaatgtaaatactatgtaaaaagttgttacactgtattgtttagggaatagtaacaaaaaagaatttgcgtatgttccatacagatgcaaccatccttttataaaaaaaaaatttcaatcagttggttgaatccacagatgtggaacccacagatacagagggccaactgtacttgctttatcctccttctatctatctatccatccctctctctgtccatcaatccatcctatttttaaatttttattttaagttctggggtacatgcacaggacgtgtaggtttgttacataggtaaacaacgtgtgccatggtggtttgctgcacctatcaacctgtcacctaggttttaatcccagcatgcattagctatttttcctgatgctctcccttcccctaccccacccaccgacaggccccaatgtgtgttgttcccctccctgtgtccatgcattctcattgttcagctcccacttataagtgtgaacatgcggtgtttaatccatcctatttttaatgaatgtcaaagtaaatagtagacaagagttcagttactcctaaatcctatagcatgcctatctttaattagacttcaatatttgtttgcagttctttctttttatataaaatttacatacaatgaaacacctaactcttaagtgtatgtttgctgagttttgacaaatgcatacttgtatgtaatccaaacctctattcaggtatagaacattactatcacctcagaaagttccctcctgctcattccctgtcaatctctgccccaattcaccccaaaggcaaccacaatcctgatttttctcctttatgccagtcctagaacttcatgtaaagggaatgatataaactctagccttttgggtctggcttttcacttaacacagtgattttgagattaatccacattgtttcatatatcagtagtttgctacttcttattgtaggcatttattccactgtttgaatctatcagagtttatccttgtatcattggacaactggaacatttccaatttttgactattatgaataaagttgctatgaacattcttgtacagttctcgtggacatacatattttcatttttcttggaaaactgccttgctttttgaacttggtaaaaacttgcctctctagggcccacaaggagcacccggatttcctggagctgtaggacctgcaggaccaccaggattacaagtaagatcaatttaagcctagtttgtgatcacagtgttcacatggttgttttccctacatactatggattcaatgtaaacctgtgtaatttaggtcctcctgggtgagcaagggcaacctccattcttggagggttaaagtaaagcatgctcttgcgaggagctattggagttatttatcagagtctatctgaccatccaatctgtgcctctaaagcctcccaccctagctcaacctaaagtatagcccagggatggcagatccctgacacatttcttgccaccttccatttcctcacccatgacaggtattgctaattaatcataccaccatcactatcacccaccctgaatactgaagaagcttcaaattccttcctaacactgcatcttgggcagctctacctacctacccatttttctgacacaaaacctgtttatcatcactggtagaggaaaagcatagccagtcatctatgtggttctgggaaagctgtgtccccagattgttctctccagtgcaagaaatcccattactcagtactttggcttagcttcaccaaaggtcatcattttaaaatttctggcctgttgggaggaatgacacatgaagtcttcactaccttagcattaatgtgattaccaggtcaatttgggggatttcaaaggagataaaagggaaccataggaaagacagctagaatctactatgccaaagcaggaaagatggctgagttactggggagtgactctcaacatgccgtgttctttttgactgaaactaacaagtgctaactctttcttatttttaaaaaaaatctagggtcctccagggcctcctggtcctcttggtcctgatgtaagtatactttgtcttagggcattttgcttcctactcctaagtactctggatttcccagagagatactggtttggttaaccctactttctggtaaaaaagattgcattccaatttaagttcccagagcttatttagtaatcgattttgtttttcctccctatatccctattccctaggggaatatggggctaggttttcaaggagagaaaggagtcaaggtaaacagcttttaaaaaatacagtctgccttccatatgctgcaagaaatgtgtctgattacacacatgtgcctgcttgtgtaagaggatttgttttttcgccttgggaaatgaatatttcccaacccacatagatcctctggtgggatctcttgagggctacatgtgtacatgccacacatgggctattgtggttcttttcccttcaaaatattgttatttccctgcttcctacctgtgaaaggtgtatgtcttacaaacatattcccttgaaatagattctttctcttccttccatctgggtctttccttggtgttttgtgtattctgttgccttctctttccttgtctctgcttcccctcttctctctaccctttctcctcctccccctcctccacttcctcctccttttcctttttgtcctcctctctctctgtatctctctctctctcctctatctctcttctttaacctctctttcaccattctcttttatttccctccttctctcatttctctctttacaaattgcattgtgatttcagagcctcaagcgaggctgagaacttgccattcccacccttctgttacaattgcactgccttctgaaggaacaactcttgcctccaatgttctaacatgaacatcattgcctctgattgtgctctttgcaaggattagaccacttagagttggatcattgttgccaagaggtagccattcacctcgttctgattccttttttaatctcttctaaacatcctttcatagcaaccatgaacttaaagtttccttctatccatcttgctcttccctctgcagtgctggtacaaaattcactggtcgggcttataattcttctcaccctttggcagtgagagttttgtttcctcattggcatgagggtgaagaggccaaagtaagagacagtttatttgtgagttacatccagaggacaaacccccactctggaaaaacggtcggtgtgattgtcactttgcttaatgttccatttgatcttacagggggatgttggcctccctggcccagcaggacctccaccatctactggagagctggaattcatgggattccccaaagggaagaaaggatccaaggtagtgaacatttaagaataggaaaaaattaataaaacttttcctataattataatacaagaacttaactctaataaccagacaatactggaagaatagagggttctgggtaatggatttttgtttagaagtgagagtaaaaagccttctttgttttgccccttatgaaaagctttcttaaaaggctgagtatgtttcttggtgtgtaggtttgagtgtgcctgggcatctgaatattcatttaagcgctattttctctgttttagtgttgcagattcaatttttgatatgatgaataacataaacattaaatagttgtgtttttcctcctaactcccaaccctctcaatacttatggtgtccccaaagtactgtgacagaacacatagggtatgaatggttgctcttgaattatctttttaaagaagttatttgctcttaaaacttgaccctgaaaataggatatactgtcaccaagtggtgacaagagatgccctaatttaccagatctgaactaccaaggcttacactatagacctgtttgactgaaatattttacgatctgtatttttatgtgagtcactgtatactacctacatggttgtaattgaatggccgtgtactgttaaggtgtgcagatatctttcagtaacttgcatttcctgccagggttcctttaagctttgtgattcagttcccatggccaaggggcctaggcagggaaatgtgtttagtctcctttctttaaatttgtcttcgtggaagctgtaacaactccaagcccctccaggtttacaggaagtagtcgttgatttgggaatggtctggcaacatgaaagagattgtctgcttccttgatcattcccaaaacttagggagcttttccatggcacgtatagataaattcacatatcagggaatgacagatcagatggttatgtgtccctatccaaattgtaattgttacccttttcccaaaactatggatttctctgctgcctctaatttgctataggaaattgtactgaacagcttcttccactagaaagaaaacagacaatcatcctttctgtctcccaattagcctcagtatttgacattctgttttagacagttatggtccataatccttctcccacagcaaagagctccatgaactaagacatcctggtacagctgctagttagggagcctggggaatctgcaccactctctgctaccctaatcttgatacttcattggttccccactcctcagtccaagtacatgtggagagccatcctactgtgcgttcactgcttcctgatgctacttactaaccttgggctgattttccagggtgaaccagggcctaagggttttccaggcataagtggccctccaggcttcccggtaagtctctctatttgatcaatatgtatacaagggtctgattggacaaaagctgtagcaatagaaggctaacagaaagacctcttcccatggatattgtagagaatgccaccatctttattattagaaggtatttaaggagatgttcttgtttctcaaacacatggagacgtaagcatggttctccatgaggctgtataccttagaggttattagctcaagctctatagttaaaacagacctaggcttgactgctgattttgccagtttctaactatgtgaacctggataagtttcttaacttttctgagcctcagtttcctaacctacaaaaaaggggagaatgatggggtggttatgaggattaaatgagataatatgcatgaaaagggcttactacatgtctagcacttattattcagttaatggtagctaatcttagtaatcctacctccactttcatatctgcctttctagcttagatccttacactcatcagttaccttttgagggtccctatgtgccaggcattctgctggacttggaggttacaacagtaactaagtaaaagtccctgtccttgagattacattgtaatgggggagtgagggaaaaaacaaacaagaaaccagtaaacagatgaatctatagcaagttcatataatggttatataagttcatatatataaaagatgaaagaagggtaaagtgatgaaatgtggatggggaacagggtggtctacttgggacagagtggtcaagaagggcctttctgaggaagtgatgtatgagctgagacctgcatattatgagagagcacgtcttgtgaagatcagaaagagggtttaaggctgagggaaccgtaagtgcgaagaccttgaggttaagaaaacctcagtacttttgaggaacagtaagaaggtgagtaagtggaacagagtaagcaaggctaataattccagacagagaagtaggaaccagatcttggctaccttcataggtcaatgtggtgttttatttttaatgtaatgggaagccgttcaaaggctctgacttgtattgttaagatcactctggctgtgggaggaaggggagagggaatgggaagggtggaagagcaaacacagagggtattgcagtagtccaggcaagagatggtggtggtgacttagactatagtgacagcaatggaaatggaaagaagtggatagattcaaaatgtaaaaatgttcaaccttgttattagggaacatttcaaacatttacaaaagcagagagaatgtcataatgattcctcgtgtacccatcacacagttttaataattagcaatttatggccaatctgaagcaaatcatatcatttcatcacaaatacctctgaatatttaaaaggtaagggctttttaagacatagtgacaatatcatcatcagtaatttgtgatcagtaattaatatcagttaacaaggcagaattcaaatttttgattgtcttataggtatatatatatttttacagttgccttgtttcaatgagaggccaaacaagaccaatacattacatttgtttaatgtgtcttttaaattacaagatatgttttgaaacagctgacaagattttcatggattgggaatagggatcaggtgggaaatggatgaatcaaagatgactaggcctgcctgtgcttgctgggccagtggggatagatgactccattccttccctacagtactttgagatagtttgggtctctctgggtggccagaaagcagagccagtggagccagtggcacaggttccttctatgatgattcttattactccatagaaataaagggggcatggaaaatcatctgttcaatgcacttgattttaatcacctctgtatctaatgaaccagaaaggaagagaaccctagtgttggagacagaacacccaaactttagacccagcccctgctctgggactttggcaagtcactgaacctctctttatatctgtaatttgacaatggtcatatttatactttttattaatagaaaatatttctacatatttatagggtacatgtgatattttgttacatgcacagactgtgtaatggtgaagttagggtatttaggatatccatgaccacaaacatttatcatttctatgtgttgggaacatttcaaatctctcttctggctactttgaaatatacagtacattgttgttaactgtagtcaccctactccactatcgaatactagaacttattcattctgtctaactgtatgtttgtacccattaaccaacctctctccatctctccccccaccccacactcacaccatttccagccactggtattattcattttaatttctacctccatgagataaatttttttagtttctgcatatgagtaagaacatgcatatagctactcttttaagacccaactaataatgtatgcgaagtttctttacaaaatataaggctgtcctgttcaataagataacagccagccatgtgtggctactgagcccttgaaatgtggctgatctgaaatgagatgtactgtaagtataaaatacacaccagatctcaaaaacgtagtatgaaaagaaatctagaatatctcagtaacattttttacttgtgttaaaatgacaatatttattatatatttggttaagtaaaatatatcatttaaattaatctctgtttactttgcttttttaatgtggctactaggaaaatgaaaataacatagtagctcacattatatttctattggacagtacagatataaagtactttgcaagtgagtttgggaataaggttttcacctttctttgtagagcatttcacatagattctagccacctggcattgtccctgtgaggtaagcaaggtgagccaggcttatcttccttgtactgatgaggaaaccacagcctcaacgggtgaagaggtttgtccagaatcacgcagctaattattagcagagctgagattgaaattcagctttcttgaattctagccaatttggtggctttttccccataccatactgccccctacagtccagtttgctctaatccctgccgtggtggggtttttatctgtaaatctctgaaaaggattttatgatctcctctggtgttattggcttcactggctcacactgcctccctccccttcccttccacatccgaacccagagtatttcccctgctgcaatttcaacccattcccttttgtcctgtaaaagaaagagactgacgacaatgcacggtgataaattgcagtaccatttcaaactcagtatttccagtgtttcagagtgtgggctgaaaaatagaaaccccagttgattgtaaagacatcaaagctagaaaataacccctttacatggaacagcatgttttcatacggtgggaattaagaaaccagagttctcagcccactttggcacagattcaatgtgtgaccttggccaaatcaggtaactccttcagtcctcatatctctatctgtttaatgggaacattcgtaggtactttatatgaatggcttatgacagaaaagttatgaggagaaaggtggtaatgtatttgtgatactctgggcttttcagaggaaatgtgcttctcaaatccaaagccttcacatcagctttcaattatccacactcaccgagaaacaaggcagcactgaagacagaaatctctagggaatccaaaatgttccttttaactatttgttttcttcctatatgagtccaaatctttgtaagagacaaagtgcccaacctgacagatttgccccttaccttctttctcttggcccctctgcagtgaccaaacatccctgattttctggctcagtcctcacctcacacattttatcccattgtctccagcaacacactcacacttgtaggccacaggtccttccatggaggtcatcagagagaattgtatatccatgtgccctctgttcaagggactagcaaacacaggggaaggcaaaaatggaatagatgaggggagggataagagaagaaactggcaaatcctgaggtaactattgagtaggtcaatagttacccacacacctacccagtaggggtaactactaggtaggtggggttcttcagttgagcctcctgagaaccaaagagcatcaggagtccagagcccaggagagcaggcctggaaacagttaacctagccccattgaggctttccaggccatgggtaagtaggagtgtgggagcagcatttgcaagattactcatgaggaggactgactgtcacggggccagtcccagggcatcttgctagaacagcttgttcagcagggtccctgtacagtgcctccctattctgggagacaagttgaacctacagcacagccagtgtcttgccaagctatttatcttttcttggctctaacccccacacaaatttgtctttttttttcctttttacatttttttttacatatttatttttgttcacactatagcataagctctcaggccctctgagaaagcaagactcttctgctttctggagaaggagtacaaggcccccttatatttacaactgagggcaagatagatgggggcacaagatggttcctgaacatcatttccttcaccctttgcaacagttttgttctcttggccattattccattcagttcaacaagtatttactggaccaccttgtatgtgttcagactgtagtaatgggccttggagaaagataaaagagagtgtaatataggtctcatgcttacaaaactttcatatgcaaccattctttgcactttaagagtttcgggcagcatgggctgccacagatttcatggacaggtcagagaaggcttcctgaagcgtttgacctcagaagccaatagacattccaccaagtcgcagcatgccttggtttgatgcagaaaaactcatattttaaataagtttgcattcagtttaacccacgagcctttcacattagaaatttaatgtagcatgaaggctgagctatttgatgcacagttatactaaatgcagaaaagagaacaggtaagtacgggaccaaagcctgctttgaattggatcctacacacacacacacacacacacacacacacacacacactcctcccaataaaaagacaatgaaaacaacccacattaaagaaacaaaaacatgactagccaaaaggaaacagaaatgaaaaaccctgggcccagaaagccaaggggtccttaaccagctttcagtactcatgggagtgcactgagtatgtatgtaaaaggaagaaaaaggtacaaatgggatttgagcaggtgagccaggtcacattaaagggacaacagatgttccacaacatttagtgccttttcttcattgcctcctttactttcataataagccaagatgttgtttgctaaatctatgctccaaaaagtacaattttaaacaacaacaaagtggcctcatttaagttttctgtgaaaaacattattcactttagtactgaactattctgtatcttgggggcccagacattttccctggacccagagggaagttctctcttactcactctgcttcttggagttcctgcttttccctagagaatccccaagtcatattcatggctacaaaccctcacctctgatgagcagggcaagagggcttggagaccatctcacagtcccctttggactatctctagggccaggcaagagccctacagtcccagtacaggagctgcagggtttcagtccgtgcctagatagaaatacttcttaccactgaaaaggatgttgtgctcattatgtctccaaaggggaaaagctcttgctcttccccctagtatcaacccccaagaatttgcataatcctccatttgtgggtcaaatcatcaagttcctagatgatagaaggcagcttgttttaatggaaaagtccccggaatgaaaaacacaagatatggctttctcattcatttttaacccatctagatgttggtttcctcatctgtaaaatcaacaaggttagatatttaatcatttctatactgttagcccatgatactataaatacatggaacagtgttgtgggtagggggagacattacttctagaaccaaaagggaaccttgaatgaatggtccaatttatattcagaccctatgtgcttctcaggcagtgacaagagacagcatggtgagcctccctaaggggagagtggagcttaattaaaatagcctccttgctttggatgaagccaggagaccgacaagaaaacaaacgttataacttgtggtttcttttttcatttagggccttggaactactggagaaaagggagaaaagggagaaaagggaatccctggtttgccaggacctagggtatgaacctcgaatgttacttgcctgggtctgtcaagtcatctagtccattttctttcctgtttgcttctttatgttttgcaacttgattgccacctaagcttctcgtttctcctcaacccaatggcaggttcctaagacctccttctctcttagccccattcccttgattgaatggctcccttgaaaaggaatgaggcaccccctactctaggtggctcctcagcctattcatctccttgctctcatgtatcattgtcttctgggctaaagaatgataccaagaaagaatgattgctaaagaaagcaaggcaagtgttgccttgctttcattccattctattctgagggaattgagcagggaagtggcacaggaatggaagaaagagggccaagtgcaacctttataggacagaaacaagcctggaaagttctagaacatagtgagtgatgtttggagtcaacagtttccaataataatctcatttgaaatggaaaaataactattagcctctctgattcctagcttcgggcacttaggtcttgagctagaagcagtgggccaagcttagcctcaaagaagtaacattttagagaattgtgttgttaagttgactatgaagtttagtaagagtcttttgagtattcagccatacttatccattaccctgccatttctttctctactttcccccgctccttgtcttgaaaatacatataatcaccaacaaagaatgcatttgaggtggaagacgaggccctcccataatctatttaaagatctcctgacttggaactaatgcagactaagtataataccacccagcctttctatcaaattccacctactacttaaactgtttccatttatttagatattaaaaaatgctccatgtggctatttagcctgatggattagagcttagaaagaagtcattaggccaggcacggtggctcatgtctgtaatcccagcactttgggaggccaaggcgggtggatgacttgaggtcaggagttcgagaccagcctggccaatgtggtgaaaccctgtctctactgaaaatacaaaaattagccaagcgtggtggcgcacgcctatagccccagctacttggggggctgaggcaggagaatcgcttgaaccctggaggcggaggttgcagtgagccgagattgtaccactgcactccagcctgggtgacagagtgagactccatctcaaaaaaaaaaaaaagtcgttaagctaggtctaggaacattcgcttacctgattttaggagctgctaaatcctgaactcagttggataactttgttatataagtctagtggctttttctaggtagcctattgctgtttctaaggtgtaactattttctttacagggtcccatgggttcagaaggagtccaaggccctccagggcaacaggtattttggttaatatcattaaagccttggggtataaaatcccaatcaaaagtcccccttgctttacctaacatggccaaagggagacattacttataatgcaaattgttcatctcccttttttttggtataatcttagccactgtcctcttttcttttcactcaagaacatgggtatccagtgtcaaattccgtgccttgccatgccatgctgtggtcatacatctttggcatgctgtcagggactagcaaggccagcctgcttgtatccgtgtctagccttatggcccttgtacctcctaatatgtaaattggctacctactgccgtattgtcttctggaagattttacagcttccagagtcagatagaagccacatataccctgcaatgtcatccaagatccctgtgccatttgccctggcttaatccaaagaccagactctcttatgctctcatactttccacttagtggtaactatgtttctgtcacagggcaagaaagggaccctgggatttcctgggcttaatggattccaaggaattgaggtaatgttgggaagtgaaaaatccagggttggtaggtagaagagtgaattaccacaaatgtctgtatataagatgaagtatttttaatattttgaccttttaagtttcaattttttcttaagaaatgcatgtaatctgctttgaacacacaaagctgctaatgagcatttcttagatactacttgatcagtggtaaactaaggggcaggagctggtgggagcaagttcatcccgaagatgaggaaaattttattcatattgcttagaattgccaactgttggtttcactattgttttaaattctctacagacaatgcatcccctttttgcctacacctggagcatataactgccaccatcacaccctgaatatgccactgtatgtgtttttggtacctaaatccctctttggggagtattagaattcctttaatttcctctgcctgacatcatccactaacaagggttgtgatggtagtagaggcccaggcctgttgagagtggaaaaaagttaaaactctgttctctccttagcactacttaggtacagccaaggcccagagcagactgtccttgagtagagttgcaaaataaaattgggatcccttgtccttgacaggtttccaattgaatgttaggcctctggcctgctttgtgtcaccttcatcttaaatttatgggactttgaaattaacctatggactagttgatcttgaaaatctggggttatagaaggaagaacctttcattttcctagggatgggctttaatggcacatagatcttgggtaataaggaaatggaaatatttgtgtttaatgtacttaatctttgcagggtcaaaagggtgacattggcctgccaggcccagatgttttcatcgatatagatggtgctgtgatctcaggtgcaacttctcattaatttgagtggaaaataaagacaggaagttaaatcctatatcccctgtaattattaaaaggatactttgttagttactcgattgttgctaaacttgacacacccaagagcccctcatggctcctgagcttggggaataaagctatctccaatctcttggtcagggaagccaagcccagcaccccatttttgtgttcagtccactaagcctaggatttgggtctgcctgggcctgaatttgatgaaaatggttctcctggcaatgctttgggaaggattgataaccacccccaagctgggctgacttcagtttgatactatggaatactcagggcctcatgtaggtgattccatgtatgcttgagcttgacaatttcataggaagtggaaaagtacctttagttaggggagcaagtggctgagagccctcaagagtgtgatgcttagaaagtctgtcttcacctctccttgtcctagttattttgtgtgcccaactcttccctttaccttctccaaagactgagatgcccagtatctccagctacctcttgtttgaccaaaggcttctactgtagtgactcttccatggatcttccaacttatccctctcctctcatcctctaaggcccatgccctgtttggtattaatatttgacagtggcttcctgtgtaccactcccaggaaacatatatgtataacgtaaatagtggacttcaacatcttaatccaaatggtagacattttaggcattacagcagattagtggtagaagaagaagaagtacttaccagagcttatcatgaaaggcaggccttggccagaacaattcttagtacactaattttggctccagaaggccccttggctccagaagacccattatcatgtgaggccattagcattagagacttgggaaaggcatgaaaggcacttctaatgccaggacagctcctgcacctcttcttgggcattttgtagcatctgtgggcctcctctgtctttatttactattttctttcattacaatgccaggtaatcctggagatcctggtgtacctggcctcccaggccttaaaggagatgaaggcatccaaggcctacgtggcccttctggtgtccctggattgccagcattatcaggtgaaaaaaactaacccatttcctacacagatcagtcctctatacactgtggttcccagcattcccttctatacctctgggtcggggcacacacctagccaaagtcaaacaagaggtagactgtagtcagtaggttcccgactgccagcccaaggctaacgtatgtgggggtagtgagggcctgggtgagcagcttttgtttttggcttaaataatgtatcatagctggacaggcaatcctagactgtcactgaggtttgcagcaacaagaggagtcctgggttgagttgctggagctgtgtcaccctcctgtggatgtgccatcccagctgatgcttgccaagaggggctagcaaaagcccagaggaagatttgtacccagaaccttgctgtaggattcagccaggcactgaatggtcccaggatcttgtgggtaacactcttgaactaatcacatccatatgtcattctatagtgacatgtgggaaaagggcatgccagagtctgggaggcagtgatgccccagatataaagttcaacttttacttttaaagccaccagtttctaaattccttggagatgggctgctgtgaggatacctatgtttttaaagcagccacctggaaatggtacagctggccccaggaccaagttggaaaaaaatcaagaaatgaaaggctagagacccagattttcctctcaggtttgccactgagaaatgctgggcccctgatcatgtttcctctcttctttgggtctctgtttcccaagaggttaggctaattgatccctaaggatccttctaactctgatacaagagaagggcaaatgcttccctaaattcttccttggatttgtttccaacatatgccacagataggaatactccagagagtaaggtgatataatgagcatttgtgtgtgggcttattcttccaggtgtcccaggagccctagggcctcagggatttccagggctgaagggggaccaaggaaacccaggccgtaccacaattggagcagctggcctccctggcagagatggtttgccaggcccaccaggtccaccaggcccacctagtaagttactcatttctctttttggtctcaagattcagatgtgatccagactgcagaacagtcatgatttttgagggggcatctcacaggtgaaacagctaagccaggatacatgataattgcagaggggcagccatgaaggccccgtcgtctctgagtcagatccctgcctctaccagttattgataacagcagagtgttctccatcaaggaacaagcaaactagggcctaatgccttccaagttttgtacccattcccactccatctttcactgttctcagcccttaagcctttgttttttcagctcctaaagaagcaggattggttcttttgagcttgccctggtccacaaggctccaatggggtgggctgagagactgagaaaaaaagaagccaagcctggaccctcgaggtggctgctaaaagcctacacagggcttatccttcttagatctcctacttgagtgtgagattctagattctgagagaaaagctggaaatgttgcccagaatgtttctctgtaccttaaagcccatgtccactgcggcttgcacctctttcctcttttgtcctaggggaggtttctggggtagacattgggactgctgagttttggaagctaccttgttcattcctctaaccccactgtctaatacggtgcctggaacataatggacattctgtaaatattagtagagtgaattgagccaacagaggtcctgttgactccttgctgcagatttggggtcccggtcttgaattttatttttttgtctctgctctgttgttcagcctcaaggacttgggccttggtgattgagctgctgtgttgagtcagggaagtcatcaggcttatacaagttgctaatcctttatcttttttttacccaaaggtccagaatttgagactgaaactctacacaacaaagagtcagggttccctggtctccgaggagaacaaggtccaaaaggaaacctaggcctcaaaggaataaaaggtgattttgtccccttgagtttcttggtcctccaaactccttagagaaggcttcctggggaatgagaaaaccaacagcctcgggaacctaaacagaagcaactgtggatcttgtttggggctttgattataggattgttagaagtgctatatttgggtctctaagactgaggctggcaatggaggtcacacaggaccaagttgctcacaggcttctttttctttctcctccacctgcagcccaggctgttaaccagtgcatgctgctacccctcccagtttgcaaaaccaaggatgtaagccacttattaccttcagccttaagcaaagtgctctaaacaggtcaagacctgggactctgaaaaacccaactggctccaggagaacaaccctagcccccactggtgttggagaactgatcaatgaccacagctgcctttgggtcatttcccccttctatcacttactctgaggggaagatgctcaataagtcaattaattatggttgtggcttaggccaggggaaggaagaagtgaaactactgactgaagaggggttttgggatggcctagggttcagttatgcaagatctctaggaatgaactgctttcctcagcctcaaacagagatgttctaacttactcctctcctttctcattgctccatcataaaatgtcattacctaagtatatagagtctggttaagaaatgcctgaaagcttgttctctgctattcaggtcccaggaaaactatttgatggaaaagggcattaagttaacttagatgttaattttggcccttacctaactcactacaaagctgatgtatttcttgataccattcacagtcctaaaagagggacatttctgatgctccccattctgtatttccatggggctgaaagattttctctaagtatggaatagtgatagggattatcaagcttcattatacatgagaatcacccaggggaggttattaaaaattagattatttggtctggcctcctgagactgatcgattaggactgagataggacccagcaagctgccttataaataagcatcacagatgattcatgcaggatcacactcaagaaacactaatctgaagaacagactattctcttagagttttaggaatcatcaattttcttaaagtaagaaggggcccttcagaatcttagggaaactcagggtcacctatgttggcaccaattcttattttccagacaataagcatggaagatatagggagttagaacatagtgctagtgactccttgatacctcttcaaaggtgctttgctgaaatccctatcattatttatttggcatttgtctcaacatttacaaaaatatgtacacatttgtgtcatatgtacaaaagtcaggggaaaagacattttggtaaagaaaatctttgagcggcttgaattccagactctcagctggttagtagaggtcagtggttctcaactatggctatactttagactcactgatggctgagcctcatccctgactaacaaaatctgaaccactaacacagacatactctgctggagagtgaaccaagttcatttgagtgtgttctctgcaagccttcagattccctctatggagttgttcaagtcacaaataaccatgatcaattctttattcttcttggaaaaaaatgacccacttcgttctatgttgtctttttctcccaggagactcaggtttctgtgcttgtgacggtggtgttcccaacactggaccacccggggaaccaggcccacctggtccatggggtctcataggccttccaggccttaaaggagccagaggagatcgaggctctgggggtgcacagggcccagcaggggctccagtaagtcttgccaaactttgaccctgaggaagcaatggaatctttcaagtgcccttcaatccccccagttacttttctaaagcacatacaagagagatgggattaaaacaaagttttggggttttgatctacaacatgaaatctgactatagagtctcttaaagtcctttctgctttaacctacctattttcccttttctctttccacaatttcttccttccacaacattgtttacctttgcctagcaatgtgctggcccatgaagataaaataggaattaaggtgaggtttacatcttcaaagatttcaaaatttacaaaaggtgcagaaataaatgggcaactattattcaagattacaacataatcagtgtctagaacagtgccaatatgtacccaaggttctgctctaagtcataatgctaggtgccggaattctatgaagtctacatcttctgactactccctcttctctcttttctttgtcagggcttagttgggcctctgggtccttcaggacccaaaggaaagaagggggaaccaattctcagtacaatccaaggaatgccaggagatcggggtgattctggctcccagggcttccgtggtgtaataggagaaccaggcaaggacggagtaccaggtttaccaggtctgccaggccttccggtaagttgatcgttcctaggtgattagctctacagatcttcacacctgactttgttggggggtctgatggccactggaccatgaaacagggaagaacagagtctagaggaccttgccctgcctctgccactgaaactttttgctttttgcttttcctttatgtaaagtgggaatcattttctcagaatggatcattgtctcatttgataaatgctagtaacacctgaccatatgacttaaaaatacttcagcttctcagtgacttttctcctcaagtaatctagccactttctgtgatctctggggttgttattatcctgctcatttcttgccctgtctcctcacccctatccagaaacttttgtgttgttagatcacccagagtagacaagattcatatccactaactaaagtcagaggagactgatagataaactatggtgatgatagataattttaacaaaacacaaagcattggtcacactggctacctctttcctgtagtcagaggactgtccagataaatctctgagttgaattttcattctttgttttatatgttgtctagggtgatggtggacagggcttcccaggtgaaaaggggttacctggacttcctggtgaaaaaggccatcctggtccacctggcctcccaggaaatgggttaccaggacttcctggaccccgtgggcttcctggagataaaggcaaggatggattaccgggacaacaaggccttcccggatctaagggtgagtcatagaatcagatggctttggacttggaaatttgaccccttgtagagtggttatgactcaggtgcatgaaatgtatcataagaagagacttgtctgaccataatcactactttcaaccccctgaaggatttgcatgtgaaaaaaagtattataattgtattgtggtaagcttagggggcagaataacatagatttccaccctacttcgtgaagaacttcctaccagagcagtctgaaaatgtaacagagctactgagggaggttatgagctcataatccctgggagagttcaagaagaagatggatgaccacttgttgcaaatgtcatcaaagcaatgagtgggagattggacaaggtgccctctaaattgtgtggtaatatcatcagctgggaaaaacctttcctcaactcatggaatctcagattgggcagaaatctagttgcttatagtctaatcccccattttatcccttaactccttcctctttatataacttctttttctacttgaattttagaaattatgtgtaacagtcctgcttatagtttatgaaggtgctatgctaataactaatcttcttcaatacagccagaacagctgttcatcccaacttttgggtttccacaacttctatgcttccattagtgacaccacacttataataatctgaagtttaaaattttgagattatctcttatttcctttgcaattcctcttatattctttccttctcttattgctactaaactctcattatctcatgcctagtttttcaaatacctatatgcttgttggagtaagtggatggttggatggatggatagatgagtgagtgaatgacaacaacttcctaagtagtttttacattcaattctattaagaacactgcagccaatttaatatctgtaaagtgccaatatcatgtaactcccctagttcaaagccacatatggtaccaattgaacagagatcatataatgtccaaactcctcaacttggaattcaaaagtctccaaacatggatacaaccaactttttcaaccttatatcatgctcttaattgaaacaaaaaaactaagacaccagtcttcttcactatacccaaacacaatatgttcacttccagctccaaaattttaccatgttgccttttcctggagtgctcttcctctttgtgtagtcatatcatattcctctttcagggttcaagataaaccccacttcttccattaagctttcccttgacctccacagtatgtcattgctacttaaattatatatctccttctattactgcttttactttccccaactgcattgtaagtctcttgatactagggatggtaatacttcttagagtttctttacatgcctagcatagtgcagtgttccataggagactaatatttgtttgcagaagaaagagccttcccaataaccaaggggctatttcttaaacatatttctcctgtttccaccttatcatcttgaagaattacaataaaagaagacaggataccaggtcttgcaaaattttatttatttccaaatctatttttgtgaatcggtgtaataaggttgatggtagatggtacaggttaaaacttgataattcaagattctttaaaccgagtcaatatatcatttcacaaattattgtgaaggttgtaaggacattttccttttttttttttttctgaaatgaagtcttactctcacccaggctgtagtgcagtggcatgatcttggctcactgcaacctctgcctcctgggttcaagcgattctcctgcctcagcctcctgagtagctgggattacaggcaccctccaccacacctggataattttcgaatttttagtagagacaggctttcaccatgttggccaggctggtctcaaactcctgacctcaagtgatccacccgcgttggcctctcaaaatgctgggattacagatgtgaaccactgctcctggccataaggatttagcaaataaaatcattctgcctgttggaagtcctagtgtcagctatagctttgcttctagctctgttcccagagacattactcatggtcattctactgctcctcccgtaattgggtcttcattgtaggttaaaccattttgcaagcaacaaggttttaaactgagttataataacatgacacctataaacttacacacttccaagtcttctggctattagcaacattttaactatttgagaaccagctgagtgaacagaaggaagcttgcaggaccatttttatcccaaacatcactagtccctggatacagaaagttattaggaatatgatatggtaagctatagcctgggagatgccttatgcagaaaatgtttgtcttattccattttctgttgctacaacaggagatctgagactgggtaatttacaaagaaaagaggtttatttagctcatgattctgaaggctaggaagtccaagattgggcagcccatcagttgagggccttgtgcttcaactcattgtggaaagcagaagggcatatgcaaaagagtccaaacactaaagcaaccttgctttataacagcctgctcttgtgggaactaatccattcccttgagaaataacccagtctcccgagaaagagattaatccatcctaacaacctaattacctctcagaagcaccacctcccaacacagccactctggaaaccaagtctcaacatgagttttggtggagacaaatcatattcaaaccatagccatgtccttcttgcagtatgaagagtttcaagaaattactttaataaagagcattagctttctttttctctctatgacaaacaaatataatttttcaaacctacctttcttctgcacaattttaaaaacaaataacctgtggtccccacacatttgcattgtagccatttctgttgctagaaaaaaactaagatgctattcctgaatgtgcccactccaatcaatggtagcccagactaggacagctgcattgccaggaaagaggatgcaatcatcagaagcctttcagcctactagtgtgaattattaaaaactttgggcaagcagacaactggctatttccaaagaggctctgttccagatgctcatagtaatcaatcaccctggttattactgaactgtggtgactgtgtgcttgatctcatgtgggtgcaagtgctctccactaagttcagacaagggatttggttggtgggcatatctgggctgctgagaagacttcccttgggccccaaggaacttctgtcctagtttaattttcttcttcacttgattgctctaggtgactgctgctgtagagaggttggtaaaggagacttagacacagagagaggtgagagctagctaggtctacaagctctcagacactagtcttagctaaacaccccttttttgtttacctttgtctcagacagtcacgatggcctgagcaccacactggatgccctgtttggggagtggggagtctaaggctgggatgcaaaggctgacaccaacactgcttcagaggctccttagcacatacctcttacagcaggcagtacgggattgagtgggcatgcagtctctgagaggggctgatttccttcaccatgcatgtcgatagcttggctgatctctaccttaagcaaattcattttctgaacttcactggggccataatctgccttgagaggtacctgaaaggatccacacatgtctgaactttattcattgggcccagaacaaattgggatgttaaaatcttgggaaccagagactctttttattctgaagatggatttgggcattaatgggaaaaattctgaataattaggtcatttgttgcaattactaaacagaacatgggtagagcagatttttgctttgttgagaaggctctgaattcaggaatgtaaagtagaagacagtataaaggaaaagagccagataccaatatgacttgaagtccttccctctcaccattttgaacctctgcttacaatacacaagtgtggtgtggcatacaggcataagacaaaattattgagagaaatatgtcgttgatttcctctggtttctaaccatctttcctttgaccattgtttttctcatcccggaacctttctggatgcctgtcctcagcttcatattctaaaggctttgtttttatctggctgtcacagatgaaaagaagcaattaaatcagtctgataaattaaggatgaatggcttaatagttggacccagcccagggatatttttattttactaagtttgtttcctaagacgtaaaacaatggaactgtaatgttagagtttgacacattggagccaatgagctattgagattgttgagggcaggagagtcttttgcaggatccctctcatgatacaccctctggaggaaattcttcagcctaactcaaagagcccaggcctgagccaagcacaaggttgaaaaccccctcccagtgaagcatctcaccataaagtgttgacctgtagagcatatttccatagtagggaaataactatcagaaatagctctgtcatcttgatgtctggcagggtggaggtgggtttgaccacctacggaggaggatccaggcctatggccatctgttcacctctggaaatataactgtagaaacctgaagtctggaaggcagaaagtgctgcccagactacaagcagtgtcactaacctgaggatggccttgcaggagctctactgagtactcattcttacataagataatagttcaagataataagaactattattaattgagcatgtaccagagtgctagacactgtgctaagtgcacagtttcatgtaatcctcacacacaccatatgagaaaagtagaagtagttcccattttgccatgaggctcagagaggtttaagtatcttgtccacgcagctggttagcagcagaactaggataccagctaaggtctgtctggcttcagagcccaacttgttaaccaatacattatactgttcaattcccaaccttgatttaagaaaatagaagtgggatcaggggaggatgccagcgagttcagtaagcagtttgaatcataggatgtgtacatatttttcagaaatgtaatttgtgatttaagtacaggcaaaagctatagatgtttattaaaactgttggctctgtggtttaaagcagaccttgggggattgttttaatgaataggcaaggcttatttaattagcatagcaattgtttgtaaatggcacttgagggagcccgcaaacaatttgttcaccagtattttattaaacctcccctctgtgatcttatagattctttttatttgcattatgaatgggcaagggagaatttgctaggggaagggctatgcatgccaattttgacatcttgaatattaaaattgctactttttctccttgagcagcagagttgacagtttcaaataaggagctgagggaagggtcaccacttgcctgtcacggacaagagagtggtcttaagtgtttgcatagtacagtcatactggtacatttgaccaaggacaatcaataggtttcagcagatcccaaatgaagtgcatcaaaagaacccagtggtttggggaaaacctcattccaaggaaagggtaaacatgagaacttgagggatcttggcttcaaaccttccaatctagtcaaataagcataatggacccttaggactaacccccaacacccatcctagggagaggctctatctgagggcagggtgagtaggcaattgctgtttgctgctgttcctgcacaggcaatctctaagaaaccttgttaggtaacatctgctgcataggtgactgtttgcccactgggcatcagtggtttgataagtgatatcctagcacttggacactaggagcattctcatctgtaagcaactgtactggttgtaactccccagagctaatgatgccaaggttttccagtgtgggctcccagctgctgagtgggaagagcttggctgtcctattaaatggaatagaagtaaaggagcgtactagggagaaatcttccctaactctgggttcactgaatgcacacatgttaccatttacaggaatcaccctgccctgtattattcctgggtcatacggtccatcaggatttccaggcactcccggattcccaggtatggaatgaggccagagaaagccactaaacactcttgtaagggccataaggcaaaggaagcagaggatagcccagtagtatttggggatccacattcctcctgagggcagccttggggattgaggaaacaggatggctgctggagagggcagtgtggggaggtgagacaaggagaggctctccaagagactgggattcttgactgaacatcacaaatcatacctagcacaccgactttcctttcccctcattgcttacatttgggttttcaggccctaaagggtctcgaggcctccctgggaccccaggccagcctgggtcaagtggaagtaaaggagagccagggagtccaggattggttcatcttcctgaattaccaggtaagaaaaggagtgtctcctcacctgcttctctttgtgtgtatgtgtgtgtgtgtgtgtgtgtgtgtgtatttgggttgtggtagtcctctgccaattacaggaagccaagtttgctctctggtgtgggtaggattgtttaattttataccctggcaagacacagcatacagccatagaatgacagcatattagagcaataaggaccattcaaaatcagctggggcaaccccttaactttcagatgaggaaactgaggcccagatgggaaatgacttgtccgagatcactaaaccactagtgacagagctaggactctgccaggttgtctgtctgccagttctatgagtttcctggatcaactccttaagggccagtgaaagagattgagatcagtcagagggaagttgtccatttctatcccttttctcacactctcttgttccaacttgagcttcatgattcttcactgtactagtggtcctcaaactgtactccatgggccagcatcagcatcacctaggaacttgatggaaatgcaaattttctgcctctccacaggatctgctgatcataacctctggggatgggcccggtaatctgcttgttaccccaggtgattgtgatgcttgctcagatttgagaactgcactgctctagggctcggggctcatcttggaccatgtgctccagggtcccctccagtaccctctccccacccaagaagaaggaggcatgacagcagaagctagagaactccagaagaggttgaacttttctcaggatgctatggggtggcgtgtgttcttcaacaactgtaggaccctcaggaacagtttgtggacctccgcccacagccctgcctcccagaactagaacctcctccaggtcgcagggcacagtccctgcctctgcacaaggccttgcaggaacagagactcctgaccttcaagagaagtgacatatattattaatatgttagctttcatattagaaaaatctgtctcagagatctgtactcagacaaattgcttctaaacagccatggtcttttatgttcgcctttttacgtttaggatttcctggacctcgtggggagaagggcttgcctgggtttcctgggctccctggaaaagatggcttgcctgggatgattggcagtccaggcttacctggttccaagggagccactggtgacatctttggtgctgaaaatggtgctccgggggaacaaggcctacaaggattaacagggcacaaaggatttcttggagactctggccttccaggactcaagggtgaatctttttgccccaattatttaacaatctacagaaagccttatattaattcgtatacttccatgaatacttgcatgaatctggggtgatggtttaattaaggggttaaaatgaaatattttattctgtccctcccttttgtgaaattttccttaaatagcctgagtcgactttactgtcttagtaattccaaaagtgaccataactaatagtcaaatttcttgcaaagactgggttacggctgggaatagcaacaaggctggagctgagaagacagtggcacctgggataagtcctggaagttggtttgctgacccactcactgctatctctccaggctgtgatcatttgcccttttcttttatcaggtgtgcacgggaagcctggcttactaggccccaaaggtgagcggggcagccctgggacaccaggacaggtgggacagccaggcaccccaggatctagtggtccatatggcatcaagggcaaatctgggctcccaggagcaccaggcttcccaggcatctcaggtaggtccttcagaggaagagtcccaccttgacagacttcagctaggccctgggcccagatgccctgggggggcaatagcagtagtgggacatggtcagaatttagaatgagacttgactttcctaagctctcaagtttcaaatctcaagtcacccttgcagtaccaagcagaacagattgctgcaggttagcttccaaactgttgccacaaatctttcccctccccccgcctcctccatggcctcatgcccagttttcaggtttcaactctcccgacctccccagttagagaagccaccctcatcgttgagggagtctagtccatctccatgccttcactggtgctgtgggcagcctgcttttggttggggagaagcttgagcagagtgtgaccacaccggcagcctgcctctcaggcgagcatgcctccaaggacccatggccaagtgtcttttactcagcagtggggcctgacacttgctgcttccagactcgtgtttgcagctttgcctttttctcgcaccaccctcctcaacctgcttcggtgactgcaccattcccaaccgccccttactcctggcctagtgactgaagctgagttatttgcagagccattaatgtcctttttattccctttgtctctctgtgtttctgagatcttcacataggctgcctcagtgagaaaacacagcacacaagctcacagactaacacccccaatggctctgccactcaggaatgtatctgattatacactataacatggccttgcttacaaggccagggatccctgagctcctgctgtggggttggctcccattgaatttttcccttgttgtggagttcccttcacagcctcccatttgaatcctggggcttgcagctacttgatgcttttcaatccatagaaagccaagtcagccattcatttgggtccttggggacccaaatacctctgtcgtcatgatttaatcctttcgttttttaatttccttgctttgtacctgaacattccactttggcagcagctcaggaggttaatcccattgaccaactttaaagcgtggtgaaagacgtctcagaatacctaggagaccaaatgggccttgtgggtttctacagtacttggcactagggggtctttcaaccttaatgccaaggaactggctgacttaactgattgcttgagggattaaaagggcagccctgtatccaaggctccctgggaggctgaaacaacagctcagctttaacctctacttcaccgattggctcaggaaacagccattgtggcgtgattcagactggaagtaccaggaaactggagcctacttgccaccctggcttcctagagctccattcaggggctaaagtgtaaaccacattcacaaagagacaaaaagttataatcagaaggggtttgctctccctgccagctaatgtgccatgctggaagtaataaccattggcgtggcactctgggtagtagatgctaacgcttcagccaactaagaactctgcctgttagcagtttgcatgtgctattgttaaagggccatttacaaaacctaacaagccaaaccaatcagaagctatgatataggcagtggcccagatctggccagagcctcacttgacagctgtcctgtgttctctcctgtgcttattcaggacatcctggaaagaaaggaacaagaggcaagaaaggtcctcctggatcaattgtaaagaaagggctgccagggctaaaaggccttcctggaaatccaggcctagtaggactgaaaggaagcccaggctctccaggggtcgctgggttgccagccctctctggacccaagggtaagtgaagtgatcagtgaagtgaccagtggttgccaaaaaggagcatttcagctgcgcagcttgctccttcctctctgcctaggaatgggaaatggggagggacttggacagggctttttgtgtcaagatagttggacaaggctagtgctaaagggggacctctggtcaaggtgagtcaccctcactgcctgctgggtggaacactaggctgagtatcatggtcagcaaaaccctgggcagtaccagccacactgggtttactcatttgcatagtcctaccatggaggctgatagcactcacttcctatgattgccttgatagccattggtagttgggcaggtggtatctccatttaaaaaaagggaaagtgagtggtttaaggtcacacaactggttagcagcagaacgaggctaaagctcatctccttgcctcctggccctaggctttttttttttttcctgtatcacacatgagctataactcggtgaatcataagagaggggcccaatttttttttttttttgacagagttttgctctttcgagtgaagtggcacgatctcagctcactgcaacctctgccccccaggttcaagcaattctcctgcctcagcctcccgagtagctgggattataggcacccgctaccacgcccagctaatttttgtatttttagtagagatggggttttgccatgttggccaggctggtctcgaactcctgaccacaggtgatccacccgcctcaccttcccaaagtgctaggattacagtgtgacccactgtgcccggccgagaggagcccacttctttcctttgtattgtgtagtgccatgtccctattcaggaaggtagtataatatgtaataaataagagtttggtaatgactaagactttggaattagagaaacctgggtttgaattccttctctgcaacttccttgctgtatgactttgggcaagttactcaacctccctgagcctccatttcctggtatgtaaaatgggagtgataataaaagttcttgtttttcaacaggagagaaggggtctgttggattcgtaggttttccaggaataccaggtctgcctggtattcctggaacaagaggattaaaaggaattccaggatcaactggaaaaatgggaccatctggacgtgctggtactcctggtgaaaagggtgagctggggaattgaattctggaactgctgcccatgcttttcaatatatatattttgtttgttgacttggttattcctgtggtttgtaccaaatctatgttagataataaaaatttgggcttctgaattaagtccttttaaaccaaaagacttaatcccctcttagttaacactgcatgttaaaggccatgtgtgcccattcccggaagaccagtggaggaaggatttgaggagagtctaaagttgctgatagacttgggatttgtagaagaggacatacacagaaatgtgaagttgggggaataggggtggggaataagatggaaaggccccaaaagagggctgtggtggtatgggaagaaatgatgtgaaaggtcagcctttgcctgaccctgcgtctaagctctctttctcatgctgatctccatccctgcaggagacagaggcaatccggggccagtcggaatacctagtccaagacgtccaatgtcaaacctttggctcaaaggagacaaaggctctcaaggctcagccggatccaatggatttcctgggccaagaggtgctggggcaggggatggataggagaaatgctcaagagaggcttcataaccaaacttggcttccttcttgagcaaaggccctcaagtacagccccccatcgccaacctcagagcagcagtgtggctggcagcaaggaatccaagaaggctgcctcccctgggcctgaaggctgcctggactttgagactgccatttgttattgccactgtagaactgaggttttcaaccacaggcagtggtacccctggaggaccctgagcactgtgctgctttcccagtggtatagcagaagcaactctgtcgatgccccataagactgaaagcatctctccccacttcacctttacctttaagctaactgctccctgagcctgcacttggcctgcgacctggggcacctgcatcttggcaagctgggtttttcttgcccagtgtctttttccaagtctttttatttcttttacaggtgacaaaggagaggctggtcgacctggaccaccaggcctacctggagctcctggcctcccaggcattatcaaaggagttagtggaaagccagggccccctggcttcatgggaatccggggcttacctggcctgaaggggtcctctgggatcacaggtttcccaggaatgccaggagaaagtgtaagtgtgaccagatctttgtctttataccagaaaaggccccccatctcacggggatatacccccactgcccacctctctgatcccagcttacttctcagccccttctcccaggacatcctcagaaagagttctctccttgagtctgacaggtcttcccaccctttcctgaacatctcctcctctgttcttttgttcacatctccctgaaatggcagagccttctcttgcctttacaattatccaatatctgcctgcccttcagtccccagcccaggcaccatctcctccaggagtccctgagctcccacccagctgccactctatacttatcactgctgacatcaattctagttgcttctgtgtgggtctgacttcctcaatgagattgttacagcttgagaacaagaactaccttacatgcttttttctctgcaccccactgccagcatttcatgttgagcctggcacattgtaagaattcgtaaaaacttcttgacgttttgctagaaaggtctttgaagctccacaaggtgcaacgactagcaaagaatcaagtccagcttatctgggctcatacaaggcaaggtggaagaggtggcttagcaatgagaccaacctggatttgaacctcagctccattgctcattagctctgtgatcttgtgcacactgtttaccttacctaaacctcactttcctcatctgtaaaaattgggaataatatttaaatagccttcagacagtagggagggttaagtgacatgactcatgtaaagctcttaacattgtgtctggcacatagccggctctgcataaatagcagatgtatcaaatggtctcaatgaattgaatcacagaacacctgggctccttgcaggcaaagtccctgaacttcaaaagtgtcagtccatctgatggagagaacttggtgtgtgcgtgcacacacacacacacacacacacacacacacacacacctgaagcaattgaaaataaatagttctagactggatagtcctgactacttacattctagggggatgaaaacaaagtgggaatgcattctaggagaagtcccagcatgaacagaggctcagaattagaagatatggcaatgtgcctgatgaagccgggcaaggaagcagccacgatggaggggtgtcctgggtagtggtccagtgcacacagtgacccagcccagtactcagcctcctacccaaagcactaagtggcataaatctttactggatactgggtaaatctcaaaatgaaccaaaaccataacagatatcaagaaaagaactttgctgatggcagctgacatggccacttcccagactcagatagtgtgttggacattagccagtgaaggcagattttcctctgaaaatggtaacatttgcccaaattcagactccagcacctgcacacataccacctgctacctggtggcagaaagaacttgtgttccttgcggaacctgtggcagagggctaaccctgcagggtgaagtgaaacttcttcctatgcataatggctccagagctttggcaaggacagtggtagccaactgtgtgttgagtccattgagtgcctggcctgtcatcttctgcattttctgagagactcgctagaatggccacactgtgactttctaagattcccattttgataagcagtggaatcgaatccttcccctacaaaccctaagtatgtgctctgccctttgttcatcaccttcccgtttgcaggacataacatccccacttccagcccacagtccacccttgccacagaatacatgatggacatctctcaggcagtggctcagtgaggggtgaggaagtaagagggtgggcagtcctgagctctgggcagaaatgatgattcccatattgcttcgaagggttcacaaggtatcagagggtcgcctggactcccaggagcatctggtctcccaggcctgaaaggtaaggagcattttttttttcttttaatgttttcttctagagcaaggtagatttctagcaggcccaagggtctctctctttttttttttttttttttttttttcttttttaggcagagtctcgctctgtcacctagtgtcacctaggctggagtgcagtggcgcaatctcagctcactgcaacctctgcctcccgggttcaagcgattctcctgcctcagcttcctaagtagctgggattacaggcattaaccaccacacccggctaatttttgtatttttggtagagacggatttcaccatgttggtctggctggtctcaaacttctgacctcgtggtctgcccacctcagcctcccaaagtgctgggattacaggcgtgagccactgcacctggccatcccaagggtctcttgcgagggtagcggagagtctgtgtttaggggaaagtcaattaatttacattttccctttggccaaaccccttttgcagtccttgttcctcacagacaatgcaacaaacaatggtacttaccaagatctctctctgtggctttcatggatccaaggaaaaggctgtcctttggctttgtggttttgcccatctgctttccagacttagcagcgaggagaacctcggctccagtctcttcccctgataaacccagcccactaggcaggaaaatttcccattcttgctggcatcactgttccattctggtgatgtttgagggccctgcctaccatcttctctgcccatactgagcctagtgatgtgtttcccaatggagatatgctgtatgtagcagcatttcatgccagtagtctggtagcagcatcccagctcctggatggtggttcatcactttttacccaatagataattttgtcaaggagctcctctggctacactgaatctgaaaaaaaaaatgtgttcaaaagatctcagtggtgcaaaatgagctatagcttctcctggccatttaaacaatgtattggaatcctcaggagacaacggccagacagttgaaatttccggtagcccaggacccaagggacagcctggcgaatctggttttaaaggtaaggttgctatatttttgtcttgtttgcctcacagactccacaaaactgaggattagaaggaattttggaggtcaaccccaagttctgcaacttctatccagtgcagaaaatttcctatctatcaattccccaagcaaatcagcctactcttccttcaagactcatagactggcaaagacctttgggataatggcctacatccccttagtttagaagttgttatctaaactgtccttcttgaacatttccacttattgctcccacttctgaagggatactcataacaaatttacttgcttctcaattgtagggcacctttctaatgtgaaaacagccaccactatcttttttagagtttcttcattgggtctagctccttcagcaattcagaatctactctttcccatagaggaatacactgctagaaatatggcctaatcactcagcatttttcttggttttataggcacaaaaggaagagatggactaataggcaatataggcttccctggaaacaaaggtgaagatggaaaagttggtgtttctggagatgttggccttcctggagctccaggtaccatgccacatgataaccttattctgaaagagtttggattagcttcaagccatgccccattctgaacctctgccttggtttcacatttaggatttccaggagttgccggcatgagaggagaaccaggacttccaggttcttctggtcaccaaggggcaattgggcctctaggatcccccggattaataggacccaaaggtatgtgtatttgggagcaggcagtggggaaaagtctttccctcgatgaaggacaccaactactttatcttagaagatactagctagggttaagccatgcctacaggagtcattggacatgaggaatcatgggaaaggaagatgaagagtaatgaaggcaggcaagcatgagtgtgaagagaagaatatgggatccatgaagagaagagctagcaaggaaggcaattgccctggcatgtgtagcctttccctgacttagagattgggcagtgagtttctggaaccagtctctgggagctgacaactcaaggtcttgacattgctactctgagttcttcttcaagatacctaatgagctgccatcttactcctaaagctgtattggtctctgataagagtcatgagaacctgtggtgtaggatataggttgggagtgttttcttctcccttagggcattaagtaaatgcctcaaaaaagaccaggactttaaaataaggacctcgcaatgcctttgggggcaggtagctacctcttgctgatgcttcatgattcagagttgctggagccatttttgacattctctcccctcaggcttccctggatttcctggtttacatggactgaatgggcttccgggcaccaagggtacccatggcactccaggttaggaagaccctcagggtgaagaggagggcatcagctcttccagaagcctggcaagggctggccatgaattctcgactgtggtgtatcccatatccttggactcatagctctccttattaacctccaatttgaggtcccttgatatggagaagaaagaggatgggtttttttcttctactcagattaactttctttcttgttacttcagtactctgcctctggtgtctgtcagtcaggcttctcaggccacaggcgagtgagttaggcaggaaggcctcacctccactgaggtctgccccctacccctgcatctcctcctaggacctagtatcaccggtgtgcctgggcctgctggtctccctggacccaaaggagaaaaaggatatccaggaattggcatcggagctccagggaagccgggcctgagagggcaaaaaggtgatcgaggtgagtccaagtcaggccttgtagaggctgagtgaggccttgctgggagagtcaggtttagggtacagcagggccatgtggctcacagggttgggctgtgagtgtcttcacatctctgggagtctcacaacccagtgggaatgactgctgagaaagagaggttaggctgtgcttagcattttccagtgaagactgtcagggcacagttcaccaagtccattttagcctccagattctcttctgttcctccttactaacctcaagcctctctggcatgcttggtcagagcttgcaattattggtcctgagggacagggcttgtccatttagtgagaggttggctggcatttcctcagcgtccagtgtggatggcactcccagggccctgggaagacagtgtggctgcgggaaggatcccaagactaagatgatacaagtctccaccggacagaaccacagcataccctcaactagaatttgttgggtttactagaaagcaggttctaccctaatctcggcccctgactcatcacatggcctgaagtccctttctgagtctccctttccccacctctcagaaagtaagaatgacttgtgttcttcaacttttcctcaggaaagttccaaaaacccgtgtacattccactccatgttaaccaggaaatgaattcaccatagcatcatggttaagagtatgggctctgaaatcagactagctgggttcaaattcaagctatacctctcactagctatatgactttaaacaaggaagttacttgttcctcaatcccaaatgagcccttagttttccttttccataaaatgaacattataacagaacctacctcataggttttttgaggaatcaatgaggaacgaggtaagatatacaaaagctcagtgcctggcacatagtatatacttaagaatattattgcatgttacctggggaaatcatatttgcaaaatttcctgtttctctctgctctggggcttgaggtctcaccgcattttgtttatgtgcatgtttgtgtacagtgtgtatgtttccgagggactatattcatatattaattcatttcctgctgcattttaaattgatgcatctgcagtttctgtgtttgttcttccctttgatctggaccaaactgttcttttctgaaagccagcagcttctccagaggaagggctcaaagcagggtccgagcctgcccagagactgtcttctttcatgggatatagggaaaaggggactggataaaaacacagggacattttcttttgttttcaaatcttgatggtcattagattattcattttctttagctatctgagataataaaatcacaattatgcatgtagtaaacagcacaggtcaagaaggatacatttcagcaacatagcactaaacaaaaaacaaacatgtcacagaggaatacatttggtatgattccatcaataaatgttcaaaaataagcgaaaccaaccaatacattgtttagagatatacatggtcaaactgaagaaaaaggaagaggatgatgaacaaaattcaggagtgattgcctctgagaggaagggaaggaagagggtggagggcacacaaggaaattcaaaacaagtgacatcttcttaagttgagtggttgaaacacaagtgttcattgtatctgaattattctttgcatattataaatattatgtcatatcttctcaatatctaattaaaacaatttctttaaaaagaatacaagaaatatcataccacgccccaccccacccccacaggaacctatctttgatttgacaacgggagtcagtgcaatatgatgatttactcctaagaaaacatcacagagtggttgggtgcagtgactcatgcctgtaatcttagcactttgggaggccatggcaggcagattgcttgagcccaggagttggagaccagcctaggtaacatggtaaaaccctgtttctacaaaaaatacaaaaattagcagggcatagtggtgtgcgcctgtaatcccagctactcgggggctgaggtgggaggattgcttgagcctgggaggttgaggctgcagtgagtcctgaccacatcactgcacaccagcctgggcaacagagcaagaccctatctcaaacaaactaaccaataaaaaaacttcatagagcaatccctctcattacagtactgttatctaaataactttcaatgatactatttgttttcatatttgcactaaatacgtagaggctgcatttatgtattttgttttttcaaggctttgacactggactgagttggaaaaatgggctgttttgcattttcatctgctcatttaaagtgttttattgttaaagaaatgcatgagctttttgcaatacttgaagtcagtagtgcctttatttcaggtttaataacacgtaagtgtaattataaaattaagaaacaggtaaagggagaaaaagtctccaaaaactgccatgggaacttttataatttgtgtactgcccaccactgcctactctattacacatgtggtgtcttgtttattagttttgcataatttcagtttatatatataagctatacatatatatgctttatatgtatatatacataatatatgtgtagagctgtattttcagaaaaaaagtatacaatatgtctttcttttcagatttttaccctggggataaagaaaaatatttcaaaggttcaccaaaccagaagtaacaatgctatgagtaccaccacgtggcttagctactagttttctttttgtgttttttcttttttccggacctaagaaacctagagagacttttctcaaaatttattttttctttgtctaaatttcaagattcaattaattaatgagctatttaaaaacacccaaatctaccatcacttttataaattttcatggatttaccttaataagagaaattcagcatatttttgcatttttcttgtcacaaaagataaaattcgatattaacatttttggattttcttgtcgcaaacaaaaattaagaatctcaaccaccagaacagtttatcaaccagtttgaatccatttatcttcatttgaatatcttctagaatatcccaaagtaataaatatatatcttccatgctacatgtataatatcaacacctacatttgtgttttcccatcaagattaccatctatgtatttgatatgtgaacattaaataaatcttctgtgatcagatgaaagttttggttttgaacatattacaatagaaatagttccacaaacagaaaacatgtaaagcagtattaaaattagagcaaatgagtattctgtatctattgtaataagtggttattctctttggccaaaaaggggggagggatttagtacagagatatttgttccataggcaattaagcaatcacttggctcatatcatgaatgacctataaaagattgttttccagtttgcctagaaattgcagaagatagccctagaagacacagaggcaccgcattcttgctgcctccattctgatcggcctggtgtctgttctgactggctggggcctgtggcctacgttctgtaacctttgtgcagcatcagacataactggctaacttaagaggtgttttttgacacagacaggtttaaaatcactttggaaacttaaaagtccaggtgctcagtcatgccttcttttctttctggtgtgggggaagttggcctaaaatatttccattaccagtgaggtaagggagctagaactttccaataaaatgcagctccagctggaaaaggggagtctctgagcccttgtcagttagtctgctttctgggaaggaaggattagggaagaagagccctctgctggcgttctctggtctggctcctacctaactgcttccattttctctgtgtgagcttccattttctctgaaagagcctggccatcttctgggcacacagagcctatccagccccttttatttattctttacaggtttcccaggtctccagggccctgctggtctccccggtgccccaggcatctccttgccctcactcatagcaggacagcctggtgaccccgggcgaccaggcctagatggagaacgaggtaaagacaggaagcccaaaagagggctagccaccaccttttgtctgacatttggggaagtcatgtatacagcgcagccaagtccctgttgctggacatatgtgggcgtgtttggcttcacatccctccccgagtggggacacaggggacttgagccaagtgcattttgctaaaatggtttgggaaagtctgggcactaggaccccaccgatggtgagggaacattctctgtcctgggaatgggctttggagtcctgtcagtccctaggccttctgcagtggctactacctgttcacctgcccctcgcccctcttccgatcttatccctaggccgcccaggccccgctggacccccaggtccccctgggccatcctcgaatcaaggcgacaccggagaccctggcttccctggaattcctggacctaaagggcctaagggagaccaaggaattccaggtttttctggcctccctggagagctaggactgaaaggtacggctgctcggctggctgctgggcccttccccactccacggccaggactccttcctgcagtcctgtgaagagaggccggtggctgatgttcttccctacctcacccctgcctatcctccacccctaccacccctaccatgccgggacctgacttgcttcctttgggctttgtcaggcatgagaggtgagcctggcttcatggggactccaggcaaggttgggccacctggagacccaggatttcccggaatgaaggggaaggcagggccaagaggtaagttgagagcatgtgctgggctgatccagagctcgagggaggggcctggtggtaaggttccttcaggcatcattgctcaccacgccaagaaagtctggatgtctaaaacagctggatcaaggtaccccagagaggcagtttctctaccttggggatccttcagcctctatcacctcccaggactgaagaccactgctgccttgccaccatggatcctgctactgactgcctctctgtgttaatctctgcattagtgggcattgggtttgcactcagatcaccacccacccgtttgctcaattcagaaataaagaaccgtcttttgcatcctttcccaccctcactcacacacatgcaatctagtagcaagccctgaggcttgtacctcctaaatgtgccttgcatctgttcacctcgcagtaccttggttgctacccccagatccaagccaccaatagttctcatgcagcacccttcctcccccgaccctagtggtcacttttccacatagtggccaaaaagagcttataaaaacataaatcatccagtggcttcccatggcgtaggaatgaactcaccgtggcacgcaaagccctgtgtgatgcctccctcttcatcctcatggccagcccttcccctttgctgctcactgtgctcctgccatactggcctctttcagttatccaaaaacaccaagtcctggcctaccacagggcctttgcacatgctacttctacttcccagagtgcacttgcccctctactctttaaatagcaaagtccttctaatgttttagtggtctcagtttaaatgtcattgcttgcaaaaggccactgatcattctctaaaacagatgcctccaccccataccaccctctgctccctcccagtgtccctgtgttagtcctttcctccacaacacttctcccaacttacactcagattaacagtatttgtcgagttaggcattattcatcttcatcaccagaccataatctccataaatgtctgtcatattcattgctctatccccagagctaccaggaccctggcatataataagcactggggaaatatttgttcaatgacttactaagcaaattatgctattagaaaggcagctggctggcgccgggttcctaggctgggatgccaactgaacctctggggttagaagcgtcccctcagcctccttggcactgtgctctaaccagtgagtaaaccagccaccccagccctgagagaaggctcagctcaccatattagcagcaaatgcttctggactgcctgtcacccactgggcacaatgctgggccctgaggagacaggatgaatatgacccagttcctgccctcttggagctacccaaccactggggagagagatggataaagattgtataatatcacacagtgccatcctggagatacccgggtatcctgtggggacaaacaggatagaaagctgttgattgcaagttagtaaagaaggcttctggggcccccgtcacctccctctgcctcagcctgatgttcttatttcccccacctgcccacaggctcttctggcctccaaggtgatcctggacaaacaccaactgcagaagctgtccaggttcctcctggacccttgggtctaccagggatcgatggcatccctggcctcactggggaccctggggctcaaggccctgtaggcctacaaggtgaggagggtgccagaaaaaggagatttgttggggagttgagacagtttggctgagaggctggcttggatgtccacctccaagggtgtgtcttcatcaagcgttgcctctcttccttcacaaagctcccaagcttcctgttggggagaagaagggccagcaggaccagcagggtggttgtacttggtacttggctttagaggatgtgagggcagagcaaggttgctactccagaccactcgcccctctctaatgtgctgcagagagatggagggagtgtggtggtgaataaagggccacacaagacaatgaaaaaagtccaaggctgggggacagaaaacctggcctctaattggagtaagttagaagtctctctgggtctcagtgtcctcattttcttcctcttcttcttcctcttcttcttcttcttcttcttttcttcttcgtcttcctcttcctcctcctcttcttcttcctcttcttcttcttcttttcttcttcctcctcctccttcttcttctttttatttttttttatttttgagatggagtcttgctctgtcaccgaggctgagagtgcattggtgccatctcacctcactgcaacctccacctctcgaattcaagtgattctcccgcctcagcctccggagtagcggggactacaggtgcataccaccacacccagctaatttttgtattttaaatagagacaaggtttccccatgttggccaggctggtctcgaactcctgacttaaggtgatctgcctgctttggcctcccaaagtgctgggattacaggcatgagccactgcgcccagcctcggtgtcctcatttctgatatgggatgctcgccgttgccctgcataatttccattgttgctaggaggatgagaagaagggaggaggaagtgggcatgaaggggctcagaaaggctaagttgagggcactgccccagggcagagatgcccccatgaactaagaactagcccaggcggctgcagccttgatgtgcagtgtgcacaccaagtcgacagccaagtgcatcgtctcctagtgagtcttgggcatgacacataagtcccctttcctggggaaggtgcctggggaccctctacattgagtaccctcctttgggctttctctcctgcaggctccaaaggtttacctggcatccccggtaaagatggccccagtgggctcccaggcccacctggggctcttggtgatcctggtctgcctggactgcaaggccctccaggatttgaaggtctgatgatgccacattaggaggcgggcggggcggggatggtggtctgggagggtttgaggctgggggtgagtaaaacttcaagtctgaaacttaataaacccagtggtagagcttgacactcctaagatgctcaaaaactgggctctaagtccattcactccccactaccctctgagcctgtgaagggataccctacgttctggaaggcaaaggactgttccaaatccaaatccttttctgggctctcttccagtgcttaaaaggtctgactttatactacagatggccccctgccctttacctccccttttctacccagggattctgacacacatgagagggggatgttcaagggataacaacacttgagttaaggcgtggctgtccatatacctcttctatttgtgtcccactttatattggggatgacaaattagttgtcctgagtagagaacagttcagaggctcggtgggaaactgtggcagttgatttgtcatgtctgtcatgggcaggagaggagggcaagattttaccctgctaatcctaaccctgctttcgatgactctgattcagcagctacatagttatctcctatgagggcctgcaaggctggacctgagaagtatccctctccacaccctaatccccactcagagagaccccaaggccaggtggctatgggaaggaagcctaacaatgtactttgaaaaatggggcgtctgtagctggatacatctgagatagagttgtagctctaccacttactagctgtaggacatctgagcctcaatttcttcatctaaaaattggggtggtaataccattttccagggtcatcgtgaggattgagtgagataatacatgtgtataacatgccttggacaatgtgtggtacaatgtgagtagctgatgttgtcattagctgcaccacactcaccttttatgatctgtctctctcaggagctccagggcagcaaggccccttcgggatgcctggaatgcctggccagagcatgagagtgggctacacgttggtaaagcacagccagtcggaacaggtgcccccgtgtcccatcgggatgagccagctgtgggtggggtacagcttactgtttgtggaggggcaagagaaagcccacaaccaggacctgggtaggtaccagctctgacagccagccctggtcacctgtccccacaaacaccaacagccaacccctctcttctcccagccctttctaggtccactgttgtgtagtgagttacaagcatcagctctggagtcaggtggatctggattcaaatcctggctctatcacttactagctgtgtacactgcattagttattcaacctctctaggctttggcttcctccttaatggaacaaagctaattctagtatctatcacacacgctggtggaaagattgcatgaatcaatcacccaatgtaaattgcttagagcaacatttggcatttaagcatccattaaatgttagcaattagtagtagtaataataataatatgacctgcagggcaatgatgattacctgagaattaattgttgtctgcaggtgtgctaaatcttaaaagcagactcagtctattaaacgctgtttctttcaaagcagattaattagggcagaattatacagcttataaaaagattcttgttattatcaaatttccctggtgcatttaaaatagaatttgctcaacacacttcagcacatgtacaatgttacaggattggaaggagagggctgcctcagtctggtgcaagtggttggatgtaaacccaaaccaccatctcgtcaaagcccctcagccagacctcccctgcccttgcccactttctctccttccaggctttgctggctcctgtctgccccgcttcagcaccatgcccttcatctactgcaacatcaacgaggtgtgccactatgccaggcgcaatgataaatcttactggctctccactaccgcccctatccccatgatgcccgtcagccagacccagattccccagtacatcagccgctgctctgtgtgtgaggcaccctcgcaagccattgctgtgcacagccaggacatcaccatcccgcagtgccccctgggctggcgcagcctctggattgggtactctttcctcatggtaaggtcctgcactgtctcctcccccagttggaggcaaagggccccttggactggttcccaggctcaagggacaccaggtagaaagcatagagtttgaaaagaagagaaatgcttggactgggcttggctaaagaatggagaacccagttctgcatgaatggcaggtagttatgggtgtagcggaaagacagcagtttgcacccagtggttcaggggctagaatatctgtgagtcataggtcaatgccccgccgtctccatgcccgcttcagttatgccacacccaagggaagagcaaaacacactaagatctgggaggacagtgagggagaggctgtcaccacttggggccaggacacagtttcactaatcagtccagccatggcactgtcccctcttctctccaccctcccagatccctctggcctctgctgtctcctcccaaaaggctttgatgagtgcatgctgtgtttatatgtccttgctggtatttttgctgcctctccatttcggtgtgaaggcagcggccagccatgctgtgtgtcttgctaagaaaaagaatatctgcaggcccaaagaggcatcaagtccctcacataatatcctgtgaatacctggggatgtttcttcaaataaaaggtcaggtttagggtcaggacatcccccagagaaaaccactgtggcacccattgaagtactctgccttgccagagcttctctgttgaattgccaagggtgagatggtgagagagtgtctttaaaaatgaccaaagctgcaggctccccaacattagcgtacctacctggggaaaggtacttttccttgttatgctgtgtctttggacattggatagtttatcccagtgtaatacagaatcacctcacctgtccttctgtcctgtccaccaccctgaccaggaaataagaagaggcccctgagcttccacaggaaatggtacaaatgctgtgtactaaatctcatgtgccctgcttatgggagggctcttagcccttattcagaatctctttactcttcctttacacattaattctaacatactagaatattattcctgaagatatgtaagggtgagaagttggactgcctagcaaggcatcttgaagcaatgagacatacctattaaaaaggagaaaataattcaaaggaggcccaaggattctacgggccgtaccccttggtgtggggctcttgcataatcatcccccacaaaaactgacattcacaatgacaagcctgattcatctgcaaagtttaaaataacctagtgtctgctacttagcaaagcaggaaaatgtgttgtgcatcttagaaagtttttgattctcagggtcaaagtgaggaaaattttgatgcttcggttgtcaggaaaggtcacctgaaaggtcccatgcagactctcactcttgcaaagttctgcaaagtaaggagtccctgtgtgccaacttgggcatttgtctcattggccatttgctgacacggttgtgtattaggcctcttccctatctccttgtggtccagatgatagcccggctaaagtgaagagaaacaggcaggagtgtggagagacaggagctgctgtctatgtgaatagtaactgaaaaccaccagctcatgtgtagccctgaaactgaatactgagagagccctctgaggtgagggccagggtatttgggccaaatacaacaaattaaggagaacttcagtaggttttggactgtccttctttcccttcttagagtacaatgcatggttgagagagggctctgagaaccgcagtccagaagcctattgaattttccttcactcagcttttctcagatccatttgtccgaggaaattttgcaagggggtacctaacacacctctgaacccagtgggacagtagcagtttgggaattgctgcttgacatgtagtcattgcccacataatgggttaggagggcactagggagcttggaagggggcactcttggccctgaaagctgctatgagggaggacaagcagcccctgcccctaaaacacagctcttggtatgctggcttgaactgggggctgagacaaggaaccagggcttaggaatggagctcatgtgcccctgtagcagtggagcacccatcccctccccacaccaacccttggcaggcacagctcatgcactaatctcctgtctgtttcagcacactgccgctggtgccgagggtggaggccagtccctggtctcacctggctcctgcctagaggactttcgggccactcctttcatcgaatgcagtggtgcccgaggcacctgccactactttgcaaacaagtacagtttctggttgaccacagtggaggagaggcagcagtttggggagttgcctgtgtctgaaacgctgaaagctgggcagctccacactcgagtcagtcgctgccaggtgtgtatgaaaagcctgtagggtggcacctgccactctgccccttgccctcccctgcccctcacaacagtcacctcacaaacctgaatggtctgaagaaggaaggcctgagcccctttgcctgtcaagttgtacattggagtctcatttgggctagactaccggacactcgtcaccccagccctcgggtccatagagatgagcccaccctgctgagatctgctgtcctgtttctgtcaagctggtgctactgtttgatttggatgattgtgtgactattcatggctacctcagaaagatttgatgggccacaactgtcttagactgctagctttctccttaccgtcttgatcggaaagctcttcctaatcgctaatcagtcatttcttcatgtacagaggtcagcacacattatttggcttaaaccagaacccagtgtttccacacttaaattctctaaccgaatattcatggatggctcaagtctgcacagagcaagtcctcactcttcaaggaggcccactgtgtctaggcaggcaagagaattgaaatgaggtgccacccagtagcccagagtgagctttagctctctctagaatgagcaagactgggccccacatggcttagagaggcttgaaggccagcagctgggttgggggtggtggtcattaatggcatatggtcctagacaaaccatctcctccttgccggctccccctccagccagagacagaggatgtggcctggttcaaagtaaagcagaggatgcaacaaatgtggccaagcctatcaaaggaaatgagaatgacagccttttttcctgggccagaagtagaggggtgggtgcgtaaggatgtgtgagttttgcttttgactccaggaacaaaaaggtaaatcccacatcccagtttctcagaagtccctgtttattccaaatgccatccagatgtgtgcaatgtggcaaactgaagctgcacagtgttggtttccttgtattctgaggatgttaaagactttgttaaatggttatccaattgctctttcacaggtagcctattaaactattttaatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcagttccttccaggtgattctgtttccttaagtattatataaactgtgccaatacagacaaagcataatcaatataatctgaattattgttatctttacctcctgagtaataagcatggtgtcagttttgtacatagcaaataaaataaatgaaatctgaa

SEQ ID NO: 906 - DNA, 66 bp, mus musculus
caaattgaatgcatgtggcagtgtatggctacccaggcagcaggacggagctagacattttgggcc

SEQ ID NO: 907 - DNA, 282985 bp, mus musculus
cgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggtctgtgcagggggggcgctttgttgcgggctgctggagctcttgtggctccaacagccactgggagggcacggggcgggagggatggtagattatttcccagttttcagtcttgctgtatgaatagatgcagggcgaaaggctgggaaggcagctggttccctttgccagttcgccttcctttttggttcatggcgagagagcactgaagctgcccggactcctgcccccgcccacccctaaagctctctttctttgcgtccccactccctgcatccacttccccaggctgagctttctcttgttcagggagctcagggatgggggcggggagagatggatggagatgatccagccgggcacctgggtgcctggggctttgttacatacaacaaaaccagtcctcctcagcttccagctccaggctaggctgcggtccgccggcaatgtggggtgtgggtcgggccgactagggaagtgagagaatgtgagaggacactccctgtatgtgactacacacaggaatgcagtggtgtgtgtcgtggagatggtgtgggttttgtgtggaattcagtgagtgcgagttggagtggtgtgtgtgtgtgtgtgtgtgcgtgtgtgtgtgtctgcgccatggggctgggctactcttggcattacatgtccttgggtctcattccatgccaagccagactgcagcaacacgcaggtggatcaggtccaacctgttctgcccacattggaaggataatgattgttttcaaagtgatggaaatccccccagctgggactgttgcttaggactttctggatgcggaatttcgagccaggttgaccaagccctaccagatagcgttattgttctcccaaagatgcccaactttcttagcagggtttcctctctcagccaatgaggatccaaagctcttacagtgatccctgcagtgccttcccacacccattttaattagcgcatcctaatgtcttcaggtcttacttactacagtgaagttagtggtgtgctaggatgtagttctatgtttgaactaaaaagaacaaactaaatgcacctatgtgttagtcatgaatttgatatagaggttttttttttctttcttgaatgataaggtatgaactggtatggccactttttaatcaaagaaagaagaggtcaataaaaatgaacaaaactgctaaaccttctctttgacatttttatttgtggttttaataaagcattgtttttcagggtccaaaaatatacagttaaaggtagtgattaatcaaacagcagacattttttgcatacctgctatgtgttattaatgttaagtattgaaagtatataaatgaataaaacatcatctcagctcacagggagtgcacaatctggtaggcaagatagagcgtgtaaacagacaattagagtaaagtatgacaaggggcaggcagggtattgtgggagcccaagggaggtatgcttgattggggatgggggttatgatcaagaaaggcttcatgggcgaggtgacatttgagttgagtcttgaagaattaattcaccaggttactaagtggaaaatggtatcctaagttgaaagaatggcatgtatgaaggtagagaggtcatagttaagtgagactgcagggagtccttggaagtgtgactgccaaattctcaacaaactcagaatgggtctttctggtttggagtgatgactggtggccaaaaaaaaaagccagtattgcagattgataaagaccacaacacatctctatattaagaaacatctggctcatttattaatattagtgtgttttgctttaagcaaatctgatatatgtaaatgtgagattccaaggcaaatgaactaaatggacaatatttacattgcagaatttgctgctttacaaaaggattcataatcagattatgttaattaacactgcctctctgacctttacagtgaatttcttttaaccaaaaatccactaacggaatttttccaatagtccatgaatggataaagacaggcatacctgcattacatttactttttgcacaaaaatttaccaacttcaacgcaggaatttcctctcattctgtggatgtttaataaatactaaaagaaaatatgaaaatgctagtaatgaatattaaatccattggctgtgatcttttatcattcaaactgtatataaaatagaaactaacctgaacgggatcttgaggaatttttacattttaggtacttttagtagtttcactggtaattaacaatggtacaagatttctgtgctgtatgttagttttaaaatggatatataataactgctctaatgctcgtgcaattaagccagaacaggggcacattctgagtctcctgttttgttgtgttggtgctgattgcattcataggctgataaatggccctgggagtgagactaagagactgattatttctactggaaatgcctggtggtcacaaaattatgctaggtaagagtgtgggttctgagaacatggatcagcacccatctggagcacctctccccttaaatgaagaccaaaaatagccctgggttctatttgaaaggaatgacagaagtagatgagcttgaatgacttctttcctcgtctggacaataccttgctgtggaggagttgatggcctagggtactttgggcacataaaggtcctttgttcactggctgtcaataccagaaggtatcaggcagtatctctaagatacattctccaaagcttgggctggaatggaatcgatctgtcagctgtgttgatgttcagatctgtctagttactagacagtgttttttgatgtaggttctaaagaagactagttccatagaatgttagtagggcacacctctccccatccacacacacacacaaacacacagggttttgtggtcaagttaagttttggaaattcttacttaaacataaacaggtttctttcctgcagggcttctaaaagtctttactaggctaatgaatattgtgactctccaggagtataaaatatgcagcatttctcagatggaattacccatagagcatggtgttccaacaagcatttgggtctactggtgttgagagacacgttctttgggtaaaagcattctctgctgagttctgagttcagaggctgtcggcatcttgctgggtaagcttggatgactcgctttacccctccaggctttccttccttcccccctctttaaaatgaggttgataataatcatcactctcactgactgtgatggtgtgatgacaactaagataatatctctgtaagtattttgagctgcttagaagaaaggctgtatgtaaactcaaggttattattaaagtgaagtgaagaattaaggcaattatcctgataatgcaggcccaaattctgtctttctgctgaattattgggcagactgcctcatttctctgctctgctttgactgcagagacctatcctcattcaaccttggctgactcagttctctgggtttatttcctttcatattctgaaaatttcagcatggcctttaatatcctggtccagaggtatcatcagtacagccttcagaaaaagtccatcaatctgaacatacactgctgactagagaaccctggagttaggaattaagtttagttggaaagttgcttttatccttcagactaattgtctttcagaagcatttgtaaagggccatgttggaagctagctggtgcaggatttctctccagtagccccaacacccaacctgggctggagtcctgtttacaggagacgcttcttgaacaacagtttcaggggtccattttgtcaatgggaagctgaggccatctttaaggaaatttaaagataaaggaaatagcattcatgtgactattgacccttcttggatcccttgactgctattaattcccagaacctttttttctttacaaactgccttgaaaggagaatggagttcttgagacttaatggctgataatcattgcaaactgggtttggggtagagactgttgcacaaggcattcagtctctaccccaaaatgaacgtcaagacattcgggttgctggttctagagtactctatactcagattagctcttctctgcatgaaagcagcaagcttcagttgtaataggaaggatttctgttagccacaagagataactgtgtgactttaagactgtgtgatgctgtaaagccagagtgaagttattcgctgttctggagtacatagtggagatgcttgttcagtgggggacattcatagaatggtagagctacaaatgcctatggaagtttctctgttgtaaaccttatgtttggatgatgaaaatgaggatggaagaagtgaagtgagttgtccaaggtcacacagctaccacatgacagaacagaagtcattctaagagttgaaactcagatctgctgcctcccagtgttcttctctttgacttaactgccttcttgtgtagttcaggggagtgaggattggctcatttggtgggacttggaggtcatgtccagttctgagcagtgtgggctctcacattgcagttttagcagagggataggtttctagtggagacctaaaagaccatgcttctctctctccctcctcattcctcttgagtgtatagttgtctgattcaccaagccaagcacccagttggtaacctgaggactagatattctacctgagattcatggtggatgatttgatcatcctagtccttttactttggtgattgattaataaccattttctgtgtgccaaggatccccttgaaagtcatgaaagctactgatgcactccccagagaaggcctctcatccatggacatgtgcatgtaatttcaaagcattgtaggtcgagagctcttgctctgcttgctgttggtattggtacacagcctagggtgactggtagaagctccctaaatatgaaagattcccagaggtggaattgtcaatcttaactcggagggaaatggaaatgctgggatgagctttgtgccaaatagacaggggacagggagtagagtggaatttcttatggataaaagaatggaattggatcctgaattcgagataaaaatagaaaaggaattgaagtgagctaaccatgtccccttccttcaaccttatgaaagaaagtgaagtggggaagctaggcaggtgggaaatttgggaggactggggagggggtcagtccagaaaggatggcaatcatgccatatttaaatgaaataaaaattcttcccaaagaatgagacaactctttcacttctctccagatttcttaccctagtcaaacacctaaataccaaaagctcagggctttgggtattagaagttgtcttagattctggaacactgtctccttgaaaaggacacatttaaaggctgggagtgggggctggacattgtgggggagtggcacagcatggctctcttcttgtttacaaaagcatttttattatcaaagaacacatgctcattcttgcttataaaaatagagatatgatgtagaatgttccttccttgtctctccaacactgatcccccaccatgttcacaggttggtatgtatcacattgtgcatgtttttatgaatattcacataaatacattcatgtacataaaataatcaaagatgtgaccatgtgctgttctacagaatgctttttactgaactatatgtctgaagatcttttattgccagtagacatctagttatttcattcttgtttttaaattttactttaagttctgggatacatgtgcagaatgtgcaggtttgttacataggtatacatgtgccatggcggtttgctgcacctatcaacccatcatctaggttttaagccccgcatgcattagggatttgtcctaatgctctccctctccttgtcccccaacccgtgataggctccagtgtgtgatgttccgctccctgtgtattttattcttataaataactgcatagtattctattatataattgtaatataatctctttaatccaacctttgttgatgaatttttgcattatttctgattatttttacattattaaatattggtgcaatgtaccttcttgtacatacaactctgcataccactgtgagcaattttgtcatataaatttaaagtagtaaagttgctggtttggagtttgatttgcacatctttgattttaatagagcctgccaaactgcctctcagaaaggctatcacaatttaccttcccatcaacagtggccatttctccacactcttcctcatcaatttcagatattattgatctttttaatcttagacaatgtgaaggctgaaaaaaaatctcctttctctttgcatttcattgagtactagtgaggttgaacatcttttcatgtgtttttttggccatctgtatttcttctgtgttgccatttcatatcccttgcctgtttttcttttgagttgttctttctgcttctgataactgggttctccttcttttgagttgttctttctgcttctgataatgaggatctctaaatattttggatagtaaccatttaactcttctctatgttgcaaatatattaagcagtttatcgtttgtcttttaactttgatttggatgtctttcactgtacagaaatgtttatgatttttgtaaaaatcacaattttcaatctattcctttataagccaacaatgccacaattagatatccttgcactatgtcatatacagttggctcattatttccttaagataaattcctaggattagatttgttcagttaatatttttctcgatattgccaaattgctttctaaaatatttctagcaagttacactccaactacagtgtatacaagtacattttccccctcctcctgacgtcttctgataattcaggttttggctcttaaatcaaatgctaggctgaaattcatatttgactgggaggaaaggcaagactgagaaaggctgggagcagaaatccctaactgcacgtggaacacctgtaatacatgtttcaccttcaattatttaagtaaacatgctctttaattcatttccaactagaactgtgtcgaaagcgttttccaacgttaaatcactctaaattcactgtgaaatgaatgaccatttagggtcatctctgctggcagcatctgcaacagcaggcaatgatgaactaactttagagctctatctcatcttaagacacttggaaaaaatctactgctgcatcttcactgatctctgaggtcagctagattggttccataactttctgaaggctgagtggtgagtaggaatcagtttctatttaacttggcttcctgcaaagaggacaagtttgaggtcctcccatgagaagttattctaacagaaataaacagtgatgtcacactctgcaaagggtatagtgccaaacaagtacaggtgtagctttttcccttactctgcctgggcttgcttcatcttcttgtgcctgttttctgccagtatccagatatggtcaagggtattttggtgtgtgctttaggccaaaggtagggtctgtggattagaagatggaagtctgagtggtagtttatgtagcttacgaatatcttttgtctgaagagcacagtagcaacctaaaatcctttggaggtggcagggcaatggggaaacatgaaaaagtggtgatgatagttgttgcttacccattttacagatggagaacacatctggaaaggagaaatgctccaagagttggacactgctggaaaaggatcctggcatacctcctaatacttgctaactaaagatttggcaacttctctcctctagggatatatgtatgtgcctttaaagtgaagcttcctgatttgatatgtttaataatgccctttgtacttacccatcattcactttatctagtgtggtactgacacagcccaccccagggacgattttgagctgtcagaagatgggtggattattgtccccaaaggaataatttggattacttgaactattgacaattatgagttgtggttttccacttacctcaaaatcttggtatttggcaaatgactttagattgtatctaatatttgtctttttttctcctttttaaagatttggactagagtaagcatagttcacagaggaaatgatggccagataatataattattaaattttgctgccttgaaaaaagtggttttagtttttatgctaatgaatgtcctgttttaaaactagtgtttctctttttaattgccaaataatttaaaattgaaacatcatagccacagatatggattctatgcataaatcatatgatacatttatactttttgatggttacaagtggaaaggtcatctttctttttaaaactatgcttggtgctttaagtagaattggaaattgtcatgtttttcttttctaatgaactattctgcaaaggtaacattgtttttttaactctgattagaactggaaggggatgtctgactccatacttaatccaaaaataaaaacctcattaacaaagaggcaaagagagtcagtaaatggagcttacattaaattgggaggcagaagtccagggttcgagttctggttttgttattaattagttgtgtgaccctgaactagagcttaaatgcctctgagcctcagattcctgacatataaaatgagggcatcgttaggaattgatgatccatattgtaattccttcaacttaaacaaggcattctcctctccaaagtcaatgtttgctttgtgacagaatcacttggggacattttaaaaatatattttgaaggccccacctcaaccagttgaatctgaactccaagggtagacccaggaaacctatttgttaactagcttcttaggtgatttgggagaagactggaacaccctccagaggtaactttcaggaggcaagatctcctggtgttttctggcttgagggaatgaaagcattttcaaaagtggggaagtccaggtcacctaggagctctggcttagaaatctatgatatgaaactgcacttgaggaggctggcttttggcctagctccctgggactggtttctgcagaggtgaatggagagcacagtgttcttcttaagaagagcgagtttggacgaacaaactgaccagtcatttaataatgagtatatttcaagccctttggcacactaccttgagaagaagcattactgagagagggcacagtgatttccataactcctagactgttttggcccaagctttcctttgaatcctatttcaaatttctattccctctttgactttttcaacttttgttcttcttcccttcattaaattcacagtgttgcagtgggtttttcccacttccccttgatctcactgatcttatttccttcagccataggcactctctcaataccatcctatcttctaaatgccaaaaagaaaggagtcagcactagtgtacaccaatttgccccactatttccttctgcgccaactttcagcccttcacttcattatgggagtagttggagctagggaaatgcttctctaaggcaaactttcagagacagcaagtgtttctttttatatatagctcccatttattaactgtttgttgtgtgtcaggtattgcactgctctttgcatgtgttgtctcatttaattttctctgcaactctgttaggttaatactgttagcattccattttacagaggagggaactaaggctcagagcagctaagtgatttgcacaagttcactcagatggtgagcagcaaagtgaatctctgtctggtcttggggtctgaatggttaaacagagtgttctactattaagggcttcctgtggtaataagactgtgttacaccaaaggggaatgtatgaagcaacagatcttcttgggtgtgaccagtctgagccttgaagcaacaataaagaccaggaaagaaaggggaggttcattttaatggcagcaaaatgttgccagaattattgtgtgtcattgtaggggtggggctcagagattagtcttgattcttgtgaattgttaactgagtaaatctctaaatattatcattgagagataaattcctgatatccccatgactattgtttgtgtcacaaatcatgggaatgtggaacatactttttgttttcctcctcctactcccagcaggagactagtgccaagggtatagaggacctctgggaggcagggagtgacttcctggatgttttcagctaaagggagcctgggtgggggaagacaaccagggagaggacccagaataacatgaataacagtgtcattggctgggattattgggtttccagctcactcaagttcttcctgtctgattctcattatcaaacttgcagcatgcagcaaaggatatttggcatccagcaatacagactcattgatctacgactgatacgattcaaactcatgaacataaccaaagcatgcactgcaatttccagactatacgtatgggaccaaatccatccttaaaccctaacctaatgccctttttgaagtagccgaacttttcactttgactgtagtatagggcattgagcaatttaacatcactgcacaaaaacagaccatttgttttctttcccgcagctctttcctagaaagatcttctactggctataatttctctaaaaattcccttccaattggagccctcaggggaggacttgcacccatttcctgcaatatctgtcctctttattgccgtttccggtaatgagagtcaataggcatcaagaaaccaaagatgagccaggcatgggggtgtgcacctgtagtgcacctcagctactagggaggctgaggtgggaggatcacttaagcccacgagtttgaggctgcagtgagctgtgattgtgccactaccctccagcctgggcaaaagagtgagaccctgtctcttgataaaacaggaaagaaagggagaaaccaagaaactacggtcttgtaaggcctcaattgcttactccatgtctaatgccagataagtcactttgcctctttaggcctcagttcttccatctgcaatgattctaattctcccttctctgtggaaaacttggagcaatcagatcactgaaaacagactactttgaaagaaaagtggtccaagatatatgactgtgaatgtcttcatgttttccctggcaaaagagctgttttggagcaaaaaagagggtagggtaaaggttaaaagatcacttgcttaagtttaagtccctgctctgccttctgctagctgtgtggtcttggaaagtttcttaaccacctaactgccttggctctgtaaaatggaaaaaataatattagtacttacctcacagagttgtggtgaggaatcaaagagataatctatgtctgtccaatagatagtgtttatttatggcaactatttttattttgaatgcatgaagctccatgaagaggtttggatcctggctcaggcactttggacagtcatttagcctctctaaacctctgtttcttcacttgtgtaatggggataataatagtagctacgtttttgggtttcttgaggaatatataagataattcctgcaaagttctcagtacaccacctggtacacagacgtgctcaataagctattgctattatcattcggttgccatcctcagaggacttgtggatcccttggtccctgcttttctatatctggaccacctatgggcctggctcccaccccagaaaatatttctggtgcctgtgatgtactattatcctcatttacccttgtttgggttaagtagaggagatagcctttttgcataggggaggccccaagactgaggggacttcttgctaaagcactgcacaagggctgcttgtggagaacagctgattccttgacctcgaaaatgtttcacacagtgaccaaaatgggaacaaagcagaccctgctttacgactcccactggagcctggtcccatgaagcacaaagttctgtcattgccctccccacgcctcccctgtcggctccaccagccatatattcccttctgacattcctccaagacaactggtcagagagcacttagtctcctccccacataatatgttgagtaaggcaaccagatgctgccatagtgacaattcctacctgatcaatagagctgggaattaagccctggtgacaggaccttctttgtggagggcctcctcccagggcatcgcctagctcagcctggtgatgaagcaacctgccctacccaccactgtctgtgtactaatctctgggcctttctctatacattaatccacatctctggggccccaaagtgaccatttcagagaaattttgacctcattggattccccaatgtttctgccttggttcagaccttcatgatttcttgcctgaactatatcatattattgttcctgctacttttacttctatgaataacaataaattatagctaacagttattgtgtacttattatgtcctagttgctgtgctagcatttgcatgtattatctcatttaatagtcacaaaaaccctatgaggcaggcactattatccccattttacagaggagcaattataataccagctaacatatattgagtgcttaccatgtgctaggcactgtgctagctgccttatatatttttttctcatttaatcctcatgataactgtatgaggtaggcattattactactaatagagatatctgtaggcctctggtagtaaaggactggataagaaccctgatacttatgaaatattcagaagggttgcatgacccaagaggactttggatgtacttttacaagtccttcctcactaggtgcttgggtacagtagacattgctcattttgaatcttgcagggaccctggccatggctggtgataggagaaggagtggtgagtctttcttaccctgggttgttttagggatatctgggatcaggctatggtagaggcacaaaaattttcatgccttgctcatggtgttttcctacttggtcttctctaaaaatccttctcagaccatgtcacttctttctttcattcctttagtcattcatcctttcatcccaaggacacatgttgattacctactatatactaggtaatgtgctagacattcggaatattattataagcgaaacagacataaaacctaccctcatgaagcttatggtctaatggaggagacaaacattaaacaaataaactcagacacatataattgtaaattatagtagtgctgtgaaggaaaagtatagggtaggagagacaatagcaggggagacttcattgagatggttgaggagcatgaagaaaggcccttctaggggaaatgacacctaagctgaggcctgaaacgtgaataaatattaacaaagagtgtttcatgcagagagagcaaattgtacagacaccctgaggtgggtactttccatattcaagtgactaaaagagacagtgaaccgggagaaagtgatgctcaatgaggtcggagaccatgcagaaccttgaaggccatggtaatgagttccctttttatgccaagagcagatggaagccaatgaagtagaatcagtgaagtaagggtagaatcagggtaatgtaattcatagttttacaatatcattctggccgctatataaaatggaacttaagagtggcgagaagagaaagaggggcaagctaggaggccatgacagtagtccaggaaaagagatggtggtggcctggactagaggtgacagtggccatgaagaggagggcaaatgcagcatgtgtttcaaaagagcttgctactagactggatataaggactaagaggagagaggaatctaggaagacttccatgtttctagcttgaataacgtgatgaaaggtgtccatttatggacatggggaagtatcctgaagcagattgagttgagctctcatcctgtgccatattcagtctaaaatgctcatttagcatataagctctattaccttgttttgatggtagttaacatgaatgcatttgttctctccctaggtaggttttaagccccttgaggacagtagctgtgtcttactcatctctatattccccaaggcacccaagatatgatgtattaaatgctgtatgattgattaacaaagggaagaggttcctttctctttcaaccttactcttcttgccaaggcatgggacattactctggattatgcttttttaaaaaaacaaatgtgacgcactcaatgatatatattatttgatatagactttgaacttcattcaatcattaatcaccttttgaataactcctgccatatgagcaagatacataaggcacacatacgtttgctctgcagaatacccttcagcagtgcagtacaggctatggagtcacagaagaatggtctcacgggaatgtgtgggctaggtcaggattggcagagcagaagactagaagtagcctaaaagcctgagttgtttaggcagttagttttaactctggaacaacttcactccaatgatttcctcccaaaagggtctattcagagtttcgagacatcttaattccccataatgcctctccatttctgcaatccactgccactaccccaaatgtaagttcctttcctctcctagggattttcatcctcatacatgtttctgctttctctttacactctatcctctttctcgggctttccgtctgtatcctttgagatctatgttgcatatcaacaaactcctctggtccttcaccctcgtgtacatcacagtgctggctacatgttagcatcacctggggagttttttaacgggtactgaagcctggaccccatccctagagaatctgattcatttggcctgaagagggacctgggtttccgtactttttagagctactccaggtgatactagtgtgctgtcaggttttcacaccactggtacctgcttgccttaattgacacatcagttctcttgcagcttatcaagtgtaagccgctcattctcctgggttgcacattctacagagctgaggggtgatagccacactctcctatttccccagaactatttttaggccttttaagttcatcctgaaaaagaagcgaaaaaagccaacagataacaaaattaaatgcaaactaaattcattgttttttttaaaaaataaattgattttaaaataaaagaaaataaaatgacatcaatgctccctgtaagtgtcatggcatctatactgctcactcttttcttttgtcaactcttgtcttcctcatgtacccacacttttcctaaatgtttaatacttggtttatcagtttcctctccaacctaagtcctgcttttctcctggaggactttagtgcccttgttggcaatctatccaacattctggacttatggttccttcatcactttgacaaatatttatggaatgcctatgtaccaggcactgttgtaagtaagtactaggtatggaacagtgaacatatggacaaaatccctgccctccagaagctcattatcaggaaggtgccagtgagggggataatcaaccaatcagtaggcaaataaatgttaataagcattgtggaaaaatttaagcagaggatgagggaatgctgggagagagggatcaattttaaatataagggaataaatttcaacaagaatagccttcactgagctacccttgcaaatatcttgagggagagcattataaacatagagaacagcaagtgcaaatgtcctgggacaggagtgtacctggctgtgaggaggcaagtctagcttaagctgagttagaaggtgaggtcaaggaggtaacatggagatgggtcttatcaggccttacaggaaattgtaaggacactggctcttactttgaatgagacagtgaaccactggaggggagggttctgggtagggaaaggaatagggtgtgacttttatttgaagtttccttgatatcagttatctccactcactttcatctctactgcactttgataacctgtccccattgccagctcctggattttgtccccaaactgttctacctctgaaatcttaaactctagtattttaattgagagagcttatatatccagctccctcatgctaattatactttctcttttatttcatctaaatctctcatctgttgattctacagtggtcttcgtggatgttagtccctcctggcttccctcttttccctctccctcctaaattccatagtgcatcttttccagcaattctcatgtgtcaatatattttttttcctatttaaccctatattatagtggtttagcaaaacccaaaccatagatcattctagtggatcttgttcctggctgcacatgagaatgacctgggatgcttagaaacatactgatacctgatttcactggtttaggatggggtctggatatagatatcttaatgatccccaagtgattgtaatgagcaaccagattgagaacctgtggactaacccagcatctgcctcttcattttctatatcttgacatctgagcagaaaaccaaatctcaactgctccctgtaaattgcttggaaatcttacaaagtgacgttagtaagctacatgtcacttttctgttatgttaaaccaacctgcaccaccctcctctaggcttcaacctcacttctgtctctgtctctcctagaagatgacttcttttcccatttcataaagaaaatagcagcttctagcaccccaagctcctgcccttctacctcaaacctagatgtacctgtgtccacttttatcctgttgtctcctctggcacttccaaaactttcctcattcttgtagatcttcaacatcttgccactgggtcttttcaaaatatctacaatctcttttgtctttaaaaaccttctcttcacctctagattctcacttgctagctactgccctatgtctcttcttcccttcacagctaagcttcttgaaaaaaggagtctttaaccaatcccattctctcaccttccattcacttttttagtcccctggaatttggtttctggtttcatgaaacacattttgctgtggacaccagtgatttcccaagtgacaaatctaatgaatagttctgtctttttctttacttgttgtttctgagtcattaattttatactgcctgtcttcctgaaaatctgttctttcatggattccatgagagtattttcttgatttacctcctacttctttggcagcttcttgagttcttcttccttgtcctagacctgaaatatgagtttggaaaaatatgaggaatctcttcttactagttcacatttctttctcagcaattttatgcatgcctttggcttcaagtatcacctacatgttcatgactcccagatatattacccccactatggatttctctcctgatccctagatctgtttatcagactgcctatggactgcctctgcctagaaattctgcaggaacctcaaagcagtgtgtcccaaacttaacttggccttttagaaatactctgactccaccaaaccagaaagcggagtcatccaagattcctccttcatctccctcaccttccacaattaccaatcctcccaaggctatctctaaaatctttgttatctatttgcttcttgcatcttgactgccacatctctagattctcatcatctctcctctggaccactacaatatcttcctaactggatttcttggcattataacagcctccttcaagctgtcttgcaaagttgaataatctttccaccatgcaaaccttacttgttatttctctgctcctatgcaattaatcattaatgactcccagggacttatagcagtggttttcaagttatacttcatgcatccctgtgtgtgttctggagtgaagttgggggcagcaggccgagcaggccacataacagggccaagccgccaagcctctaatttaactaggacagctgtgctttatatctgtttatcatcctggcctctgaagatatttcccattagagtgaaaattctacagccaaaagaaatatttgaatgctattgatgttgaccttcataactaataagcttagtatttatcaggaacagaagggtatctctgacatcaagaatgtgaaagcttcataggccttgtgtccaggaactttatcccccctagatgtattcgtttggttgcaaggcccagaatgaggcctctcacagcttgatgtgaccttttgtgtgttgtaaggccctttctctgtctttcagggctgctggtgcctgttatacacatgaaatacagaactctgcctgaagaacaaccatggccttgatgcaggcactatccctggtcagcatcagatatgaaattgcacatagttctataatttgcattttctacttaatatatgtctaatatactcctgagtgattgtagagcctatttaaaagcagcagaatattccactgaattaaaattttttacatgtttacttcatgaaatgaaattctgttgcctttatcagaactgggagaaccttaagacatcctgtccagtcctcatgctgtggtctccatgggaactaattcccagtgagctctttgttctcagggcagcttagttgccctcatttactcttccaaactgtgattaagctcaggctgtaggcttttcatctgcatccaggaaaagggaaagtgcacactcttacctataaaaagggaaatttgccattgataaatctggtggttcccaggcccatgctataaaattgcctcaatttttccagttcagagaatgttcatggtgagtggagcctatggccatggccaggcttgactgacctaagcctctagtgtcatctctccctaaacaaatattcttattaaaactgctgttaagtaaaagcactgaattgaaaattaggttttcatcaggttctagtgctgattgtgccactcaactaactgtatgaccttgggcaagtcactgaacaattctcatttgaacacagaaaggacgatgttgaaccaagtgatctctaggattattttcagttctgataccttgagtctttgatactaggagataattgctatgtaaatgctttcaaaagttcaaagtgctatatcagcgtgaggtgttatgattaattaaacttactgctttaagttcccacagagcataaggagaagtaaaggagccttcctgatacacaactgggcaagtcaacatccgaatcatctgaagttagcatggtagtgttatttactgggaagaaaaataataataagagttattattcattgaaacatgaccacatgccaaacagcatgctagtcactgtcacatacatttttattattcatccccacaatgaatccattgttactattatttttgcccttttacaaatgagaaaactgagttcaaggaggttaagtgacttgattgccatcatacccctagcaatcgatgaagctaaggtttgaaccacaatttttctgattcaaaagctcaagcattttcaagtgtgagaaaatgtgagatccaaggccatgttttctatcccagtacatctaaaactctaattcgtgtatgaatcaccaggagttcttgctaaattcaaattgctgactccataggtctggggtggagcctgagcttctgcatttctaacaagcttccagttgctgcttgatgtagcaggtccatggaccacactttgagtagcaagagactagagacctttatatggaaatcatctggcctatatttgcccctggagcagggctgcacagactgcactgcacaactccagggagcactgttcacattgcagtctctgtgcagtgtgcctcttgagttgtgtactgtgctccccttgtcctagaatgagaacattgtgagtagtgagtagatctacagaatcttcctctacctgtgccacgtctgaagaacaggaagtgttctttccctcacaaatgaaaaatggatcaatgctgttgagaaaagcaacacaaatccagtctgcccacaatgagggtggcccatttggtgttctaaggcaagatggggaggagggggagaaggaagctagctggcaagctggctggctggctgactgactgactggctggcttgctggctggctggctggctggttggcgtggcaggctccattcttatgctaacaaagctctgattccaggcagcagctgctgcttgtgtgggtgcttgggccattcatagcagcttgctttaccagtgccagacccccagaacaggtgcggccgcacttgttattttgctcagtcctgaccgtccagacagggagctgattatcactatgaatctgggattgctgctgatattccagcttctcctgaacaaaggggccagccttgagacagctgtcttttctggccacagtgaggctgactgccctgaaggccatgtgggccttggggaggtgggtttgcattgcaaatgggacggagaaaatcagacccaggtaagcagttcttctgaaacagttcaaagtgtctgagagtcagaaagtttgggggcttaagcccacagtccccaagcaggagctccaaacctattgagatctctccaagctcctcttctctggtcaggtgctgttgcccttagccttcccttggcctaaggtctgctgcagtggccaagggcaagagaagggcagctggctgacattgtccccttcctcctttgctcagcctcaggaccaggctttgggaaccaggaaattagcttctattcacaaaaaggatggagaactatagcactgtggttaagaagaccagctccagggtgaggcagcctgatacagatcttaacttgattactcactagcagcaagcatgagcttaggcaatcatttgatttattcaagcttcagttttgtcacttctcatagaagaataacaatagtacttccctcagggactattatgaggatttattattaataataatgaaagctaacactgacagagcacctactgtggactaggtactcttctaagtactttacacactgtaattcactaaatcctcaaaatgatcctgtgagagggacttgtattatccccattttatagatgtggaagctgaggatcaaaggggttaagtaattcgcccaacgtcacaaatctggtgagcagcagagctgagaattgaacctagcagtttgctccagaggccacgtcgtatgcactatgctttactgcacaaacttaaagtggagtgagcacagtgcctggcacacataaatccttgctaaatgagggtggttatgattcactaaactgatttagcctcactgtttcaatgaatagctaaatatgtgtcacctaaaaaagaaatgtatatttttttcaataagaatatgggtttccacagctggagtcttcataatggaaagagtaatagtctttcttggccccagggctccagttccattcattcatacacaaaggagggtaggacaattcattttcccacttggcttagcagaccatttttgattcccagagcagcttttcatctctgcccaccaaaccacctcctcttaattctaccgcctctacaggcccactgcttccccataacctttagccctgtgaatttgattcacttattatgtgaaagaaagggagggactcaaaaaaggagggagggagggtaggagagaaagaaaggagagagagtgagagatcaagaacagagagagagagagagatcaggggtgggaaggagatacttctaaaaagaaaacaaggaagaaaaaatagtcaagacagtcctattcaaatctaatcttaaataaattttgactgcagttttagaagaatgtttattgaaaagggaatatgtccataatatacaattatgtgagaaaagcaggctgcaaaatagtgttacaccattttgaagtgtgtatgtacaaatataaaaaaaaaagactggaaggaagtattccaaaatgttaacagtaatcatctgtaggtagtcaagttgtagattatttttcttctttaaattttctgtaatttttccagaattctaatgaatataaatgctttttgtaattttaacaagatctaaggaaaaggaaaaagcagggataggatatgtcggtactgcctgcatgagggatggatcctgcccccaagaatgccctgtactagacagaaatgattgttgtcctatgtgtattgcaaaattgcattttctgtgtgcaagggaatgctagattactcaacaagaccacagagagctttgaggcacatgctcagctcccagtcagctctgagagtgtctgatcttcctgcccagacaaaccctgacctgtggtgtgtccacttagaataccatgtgtccctgactacagtttgggaacccagtggtagagttaacattctacagacttgccataggggcaaaaaccagaacagggccaaggggacaaaagcaaacagatcagggactacgagtgcagaaggtcagagctgacaacaggaaacagaaggatagtatcttcagtgagctggagggggttagtgctgaggtgtcacgtgcaagattcttgttttgggtatggctgtgttggagacgggtaaaaagagtgtaagtaggcacagggttagggacaaaggcataactaggggccacaaactcaaatgcctttggggaccagactggtagcttaatgattgcaggggcctgggtgaggactgtgctgagctgaaagagaacgattcccatggaagagagcagtgggaagcctgggaatttgggcccacatttacatgtcttatgaatttttaagagaagatagatatccaggtatttatgtaaaatctcttaacaattaatttttttttcaatgtcaagacactacgggccaagcaaaatatatctgtgagccacacatttaaaaacatttcacttttaaataattatagattcacaggaagttgccaaggtgttacaaaggggtctctgtgtacctttcacccagttttcccaatggttacatctacataaccatcatgtaatatcaaaccaggacaatgacattggcacaatgtgtgtgtctagttccatgtcagttcatctcatgtgtgggtttgtgtgtccaacaacacagtcaagatacagaactgttctaccattgcatagatctccctcgtcacatactagtcacatccattttcctccctccaacattccttacccttggcaaccactaatctattcttcatctctatagttttgtcatttcaagagtatgacacaagtgaaacaatatattatgtgactttttgagactagctatttttactcagcataatgccctggagatccacccaggttgttgcatatactagtagttcattcctttttattgctgcatagcatttcatggtatggatataccagagtttgtctaaccattcaccaattgcaggacatttttgctgcttccagttttgggctttacaaatacaactgccatgaacaatcatgtacaggtctttgtgtggacaaaagctttcatctctagaataagtgtccaggagtctgattgctgggtcataaggtaagtgcatatttagttttataagaaactggtgaactgttttccagagtggctataccattttacattttcaggaacaatgtatcagtgatccaatttctctacatctttgccaacatttggtactgtcacaaattttttacttcaaccaatctgacaagtgttagtgatatcttgtggttttaatttgcattttcttaatggctaatgatattaaacatctcttcatgtgcttatttgccatatatataaactcctcagtgaaatgctggttcatgtcttttgttcattttctaattaaattttgtggtttttgtcattgagtttgagtttttaaaaatatattccagatagcagtcctttgttagatgcatgatttgcaaatatatatattttttcagtcttcagcttttcttttcattctgttaacagggtctttcatggagtaaagtttttaaatttttatgatgtctgatttattcatttttctttcatggattatacttttcgtgtcatgcctaagaactccttaccagccctgggtttctaagatttttcccttatgttttcttctaaaagtttatagttttatgctttacatgtaaatctatgatctatgttgagttaattttgtgtgaggtatgagagcccgggtttaagtgattctcgtgcctcagcctcctgagtagctgggattaaaggcatgtgctaccagacctgcctaatttttttttttttttttttttttttgtatttttagtagagacagggtttcacaatgttggccaggctggtctcaaactcccgacctcaggtgatctgcccacattgaggtatgagatttaggtcaaggttcattattttgcctagggatgttcaattgctacagcattacttgtcaaaaaggcaattcttccactgactttttttttttaatagagtctcactctgtcatccaggctggagtgcaatggcgcgatctcagctcactgcaacttctaccgcccgggtttaagcgattcttgtgcttcagccccctgagtagctgggattacaggcgtgtgctaccagacgtggctaattttttttttttttttttttttggatttttagtagagatagggtttcaccatgttggccaggctggtctcaaacttccgacctcaggtgatctgcccacattggcctcccaaagtgctgggattacaggcatgaaccactgcacccagcccttccactgaattctttttgcacctttgtcaaaaatcaggtgggcatatttgtgtgagtctatttctgagttgtctattgtgttccattgacctgtgtgtctatccttccaccaatacaatgctctcttgattactgtagttttgtggtaaaccttaatattgggtaaaacaattactcttgcttgattcttatttttagaaattgttttagctatgctaggtctttccaaatatattacagaattatattgtctatagccaaaaatcttgctgggatttctataggaatagtatgaaatgtgtatgtcaattttggaagaattgacacttttactatattgagttttctaatccatgggatctatccatttatctaggtctttgatttctttcatcattgtctttacatttcaacatacaagtcctgtatagattttgttacatttacacctaaataactcatttcttgagtgattataagtgctcttgtatttttaattttggttttcacatgttcattactagcatatagaaatacatgtatctaatgactagtgatgatgagctttttttcagatgtttgttggccacataaatatcttcctttgagaagtgtctgttaatatccttcacccacgttttgatggggttgtttgtttttttcttgtaaatttgtttaagttccttgtagattctagatattagacttttgtcatatggatagattacaaaaattttctcccattctgtaggttaggttgcctgttcatctgatgttagtttctttggctgaacagaagctctttagtgtagccataaaaaagaatgagttcatgtcctttgcagggacctggaggaaactggaaaccatcatcctcagcaaactaacagagaaacagaaaaccaaacaccgcatgttctcactcataagtgggagttgaacaataagaacacatggacatcgggaggggaacatcacacaccagggcctgctgtgggtggggggaaagaggagggagagcattaggaaaaatacctaatgcatgtggggcttaaaacctagatgacagtttgaaaggtgcagcaaaccaccatggcacatgtatacttatgtaaaaaacctgtacgttctgcaaatgtatcccagaacttaaagtaaaataaaataagtacaattggtttttgtatgatgatattgtatcctgcaaaccaaaacttcattgctagatcaaggctcatttttataaattcgttgacatattattctgtgtagatgatcatgccatctgtaaatagagacaattttattctttccttttggatgtataagacttttattccctttcttgtcttattgcactgggtagtactacctcgaatagcagtgatgagagtagaaatcagtgcttcattcccaatcttagagaaaaacattcagtctttcaccattgtgatgttaggtttagctttagtttttaaaaatcagcttgagataagattcacatgctgtacaattcacccatttaaagtacaagattaaagactttgagtatattcacagaattttgcattcatcaccagaatcaattttattcagtgctctcaaaataaaccacataccccttagctgtcaccacccaatccaccatcttccccggccataaacaaccactagtctccagttggtctctatagatttttctattcaggacatttcatataaatgcagtaatacaatatgtggccttttgtgactggcttctttcacttagcataatgttttcaaggttcatccatgttgaagcatgtattagtatttcagttatttttattgctgaataatattgcattgtatgcacataccataatttgtttatccattcatcagttgaatatttaggttgtttccatttgttggctgccataatgtctttttattattgagttacaagagttctttagattctagatacaagtcccttatctcatatatgattttcaaatattttctcccatcctgtgggttgtcctttcattttcttgatgctgtcctttaaagtacaaatgtctttaactttaatgatgtccagtagtttattttttcttttcttgactatgctgttagagtcagatacaaaaactactgcctaattcaagatcactaaaattcacacctatgttttcttctaaaaattttctagttttattttgtacatttacatctttttatccattttgggttaatttttatatggcatgatgtaggagtaaaacttcattattttgtatgtggacatacagttgtcccagcaccattagttgaaaagattattcttttcctaataaaacttcttggcacccttgttgaaaatcaaacggccataagtgtgagagttcatttctagactctcaattctattccattgttctacgtatgtatgtaggtatgtatgtgtatatatacacacatatatatacacacacacacatatatatacatatctatcaatctatctatctatctctctctctatatatgtatgtatgtataagacttttattccctttcctgtcttattgcgctgggtagtactacctcgaatagcagtgatgagagtagaaatcagtgcttcactgcgtttgagctctgagaatggactgactgcctcctcaagtgggtccccgacccccgtgtagcctaaatggggacacctcccagtagggagttggctgcccctctggggagaagcttccagaggaaggatcaggcaggaatattgctgttctgcagcctccgctggagatacccaggcaaagagggtccggagtggatcttcagcgaactccaacagatctgcaactgagggatctgactgttagaaggaaaactaacaaacagaaaggaatagcatcaacatcaacaaaaaggtcatctacaccaaaaccccatctgtaggtcaccaacatcaaagaccaaaggtagataaaaccacaaaatggggagaaaccagagcagaaagggggaaaattctaaaaatcagagtgcctcttctcctgcaaaggtttgcagctcctcgccagcaacggaacaaagctggacatagaatgactttcatgagttgacagaagtaggcttcagaaggttggtaatgacaaacttctccgagccagaggaggatgttcgaacccatcacaaggaagctaaaaaccttgaaaaaagattagacgaatggctaactagaataaacagtgtagagaagacctcaaaggacctgatggagctgaaaatcatggcacaagaacttcgtgacgcatgcacaagcttcaatagccgattcgatcaagtggaagaaagggtatcagtgattgaagatcaaattaatgaaataaagcaagaagaaaaggttagagaaaaaagagtaaaaagaaatgaacaatgcctccaagaaatatggcagtatgtgaaaagaccaaatctaaatttgattggtgtacctgaaagtgatggggtgaatggaaccaagctggaaaacactcttcaggatattatccaggagaacttccccaacctagcaaggcaagccaacattcaaattcaggaaatacagagaacatcacaaagatactcctagagaagagcaaacccaacacacctaattgtcagattcaccaaggttgaaatgaaggaaaaagtgttaagggtagccaaagagaaaggtcgagctacacacaaagggaaacccatcagactaacagcagatctctctgcagaaactctacaagccagaaaagagtgggggccaatattcaatattcttaaagaaaagaatttccaacccagaatttcatatccagccaaactaatcttcctaagtgaaggagaaatgaaatcctttacagacaagcaaatgctgagagattttgtcaccaccaggcctgccttacaagagctcctgaaggaagcactaaacatggaaagaaacaaccagtaccagccactgcaaacacaggccaaattgtaaagaccatcaatgctatgaagaaactgcatcaattaacaggcaaaataaccagcgaacatcataatgacaggatcaaattcacacataccaatattaaccttaaatgtaaatgggctaaatcctccaattaaaagacacagactggcaaattggataaagagtcaagacccatcagtgtgcttattcaggagacccatctcatgtgcaaagatgcacataggctcaaaataaagggatggaggaagatctaccaagcaaatggaaagcaaaaaaaagcaggggttgcaatcctagtctctgataaaccagattttaaaccaacaaacatcaaaagagacaaagaaggacattacataatggtaaagggatcaattcaacaagaagagctaactatcctaaatatatatgcacccaatacaggagcacccagattcataaagcaagtccttagagtcctacaaagggacttagactcccacacaataataatgggagactttaacaccccactgtcaatattagacagatcaatgagacagaaggttaacaaggatatccatggcctgaactcagctctgcaacaagcagacctaatagacatctacagaactctccaccccaaatcaaatagatgcaataaaaaatgataaaagggatatcaccaccgattccacagaaatacaaactacaagagaatactataaacaactctatgcaaataaactagaaaatctagaagaaatggataaattcctggacacatacaccttcccaagattaaaccaggaagaagttgaatctctgagtagaccaataacaggctctgaaattgaggcaataattaatatcctaccaacctaaaaaagtccaggaccagatggatttacagccaaattctaccagaggttcaaagaggagctggtaccattccttctgaaactattccaatgaatagaaaaagagagaatcctccctaactcatttgatgaggccaacatcatcctgataccaaagcctggcagagacacaacaaaaaaagagaattgtagaccaatatccctgatgatcattagtgcgaaaatcctcaataaaataccggcaaaccaaatccagcagcacatcaaaaagcttatccaccacgatcaagttggcttcatccctgggaagcaaggctggttcaacatatgcaaatcaataaacataatccatcacataaacataaccaacaacaaaaaccacatgattacctcaatagatgcagaaaaggccttcgacagaattcaacagcacttcatgctaaaaactctcaataaactaggtattgatggaacaaatctcaatataataagagctatttatgacaaacccacagccaatatcatactgaatgggcaaaaactggaagcattgccttgaaaactggcacaaggcaaggatgcttgtctcaccactactattcaacataatgttggaagttctggccaggccaatcaggcaggagaaagaaataaagggtattcaattaggaaattaggaagtcaaattgtctctgtttgcagatgacatgattgtgtatttagaaaactccatcatctcagcccaaaatctccttaagcagataagcaacttcagcaaagtctcaggatacaaaatcaatgtgcaaaaatcacaagcattcctatacaccaataacagacaaacagagagctaactcataagtgaactccctttcacaattgcttcaaagagaataaaatacctaggaatccaactaacaagggatgtgaaggacctcttcaaggagagttacaaaccactgctcaatgaaataaaagaggacacaaacaaatggaagaacattccacgctcatggataggaagaatcaatatcatgaaagtggccatactgcccaaagtaatttatagattcaatgccatccccatcaagctaccaatggctttcttcacagaattggaaaaaactactttaaagttcatatggaaccaaaagagagcgtatgttgccaacacaattctaggcaaaaagaaccaagctggaggcatcacgctacctgacttcaaactatactacaaggccacagtaaccaaaacagcatggtacgggtaccaaaacagagatatagaccaaaggaatagaatagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaatacaagatggattaaagacttaaatgttagacctaaaaccatgaaaaccctagaacaaaacctaggcaatacaattcaggacataggcatgggcaaggacttcatgacaaaaacaccaaaagcaatggcaacaaaagccaaaacagacaaatgagatctaattaaactaaagagcttctgcatggcaaacaaactaccattagagtgaacaggcaacctacagaatgggagaaaatttttgcaatctacccatctgacaaagggctaatatccagaatctgcaaagaactcaaacaaatttacaagagaaaaacaaacaaccccatcaaaaagttggcaaagggtgtgaacagacacttctctaaagaagacatctatacagccaacagacacatgaaaaaatgctcatcatcactggtcatcagagaaatgcaaatcaaaccacaatgagataccatctcatgagagttagaatggcaatcattaaaaagtcaggaaacaacagatgctggagaggatgtggagaaatacgaacacttttacactgttggtgagagtgtaaattagttcaaccattgtggaagacagtgtggcgattcctcaaggatttagaactagaattaccatttgacccagcaatcccattactgggtatatacccaaaggactgtaaatcatgctactataaagacacatgcatatgtatgtttattgtggcactgttcacaatagcaaagacttggaaccaacccaaatgtccatcaatgataggctggattaagaaaatgtgacacatatacaacatggaatactatgcagccataaaaagtatgagttcatgtccttttcagggacatggataaaactggaaaccatcattctcagcaagctatcacaaggacagaaaaccaaacatcacatgttctcactcataggtgggaattgaacaatgagatcacttggatacagggaggggaatatcacacactggggcatgtcaggggttggggggctgggggaaggatagcattaggagaaatatctaatgtaaatgattagttgatggaggcagcaaaccaacatgacacatgtatacctacgtatcaaacctgcacgctgtgcacatgtaccctagaacttagagtataataaaaaaaaatcagtggttcattctcaatcttaagagaaaagcattcactctttcaccattgcgatgttaggtttagcttttgtttgaatcatcttgagataagataaaatatatataagatatatatgtataagatatatatatattttatgacagtactacactctcttgattattgtacctttgtagtaagttttaatattgggaagtattagtcctccaactttgttgttcttttccaagattgttttaactatttggggtaacttgcatttccatacaaaatattgtaaaaattttaggatcatcttgccaatttctattttaaaaatgcagctggaattttgatagggattttgttgaatctatagatcaatttggagagttttgtcatcttaacaatattaagtcttctaatccaaggacatggaatgtctttccatttgcttaggttttctttaatttctttcaacaatgttttgtatttttcattttataagttttccacttattttgttaaatttattcctaaatattttattttttgatgctattgtaaatggaatcaatttcttaatttcatttttggtttgcttactgctactgtatacaaataaaattgatattttgtataatgatcttgtaccctgcaaccctatttaacttgtttattagttctaattatttttagtggattcctcaggatgttctggacactggtcatgtcatctgcaattagagattatttaaattctttctttccaatcagggtggcttttatttcattttcttgcataattgtcctggctacagcctccaatacaatgttgactagaaacgacaaaggtgttcctaatcttagggggaaatcttttagtctttcactattaattatgacgttagctgtgggtttttcatagatgctctttaccacgttgatgaatttccttcctatctgtagcttgttgagtgctttatcataaaagggtgttaaattttgtaaaaagtctttctctgtgtctattgaaatgatcatgtggttttgtcctttatggtattgaagtggtatattacattaattgattttgcagatgttaaaacaaccttgaattcctgggatgaatctcggtaggttataattgtgtaatcctcttttatttgttattggtttcatttggctatttttttgtttttgttttttatttgtttgtttgttttaaggcagtccccccctctactcctagttttctgagaggtaggtttggtttgttttttttattgtcaggaatgaatgttagattttatcaattgcttttctgcatcaattgataagattatattatttttcttatttaacctattgatatggtggattacaatggttgattttgtaatattgaactaactttgcatccatggaataaaccgtagttggtcatgatgtataattcttttcaaataatgctgaattctattgactaatattttgttaagaatatttgaatcatatttatgaaggatattggtttgtgccttctttctttttctttctttcttcctttcttctttcttttttctttctttctttctctctgtctctttctttctttctttctttctttttctttctttcttctttccttctctctctctctctttctttctttccttctttcttttgtactgtctttgtctggttttgttatcagagaataaatactagcctcaaaagtgaattggaaagtgtttttctcccctttccactttctggaagacattgttgagaattggtgttaattcttctttgaatatttggtagaattcctcagtgaaaacttctgatcttggaaaccttgttggggggctttgaaattacaaattcagttttctcaaaagttataggtctattcaaattatctattttatattggctgatttgtgatgcattatgcatttcaaagaatgattaatttcatctacattgtcaaattaatgtgtatagaattgcttgtactactccattttatccttataatgtttatagggtctgcagtgatattttcattcagatgttggtaatttgtgtcttctctctttttctttatcagtcttgaaggatcaattcagtcaattttcttgatcttttcagaaaccagctcttgttttattcattttctctattacttttcttttttttttttttttttttttgacagagtctggcactgtcacccaggctggagtgcagtggcgccatctctgcccactgcaagctctgcctctcgggttcatgccattcttctgcctcagcctgcggagtagctgagactacaggtgccgccacctcgcctggctaattttttgtattttcagtagagacggggtttcaccgtgttagccaggatggtctcgatctcctgacctcgtgatctggccttggcctcccaaagtgctgggattacaggcatgagccactgcacccagcctacttttctcttttcaacttcactgatttctgctcatatatttattattttattccttctacttactttgagtttatgttgtttttcattttccagtttcttgaggtgggagcttgattactgattcaagacttttcctcttttctaatatatgcattgagtgctataaatttccctctcagcactgctttagcagtgtcccacacattttggtatgttgcatcttcattttcattctgatctgtaggttagaagtcctggcagacttgacagggctttctgtttaaagtgtcagctgggttggactcatatctggaggttctgtggatgaatctacttccaagctcattcaggtgtaggcagaattcagtttctttgggttgtagatttgaagtgcccatttccttgctgattgtctgctaacagtcacattctgctcctagaagccacttgaattcctccttagtgacccactccatcctcaaaaccatcaactagcaatctcgcatgtcaaaatattctcatgcctcaaatctccctgacttcctcttccatttatcagtcagagaaaaccatgttattaaagggttcctatgatgagattacacacactcagataatctgttttgccatgtaatgtaacataatcattggagtaatttctcatcatgttgataggttccacccacactcagaggggaggggattatacagaagcaagggtcatttgggtggtcatagttaaaattctccctaccacagtaattatctaattcaaagaaaaatattgggaaaatggtatgaccaaaatattgaggagtgcatgacaacagtttgggacccaacggagtagttcattttaaggtccattccaaattctatgattctgtagtagggaagtcatggaatattctgcttttctgtctattgtaggggccaagggataactttccccttggccttctgaaggttccctgaaaaatcaactcataaaaggcagatggataggagaaacgacatacacatttaacatacgtgtacatgggagccttcagaatgaagacccaaagatacagagaaaattttccattttatgcttaggtcaaaaaagtatggacagccatgtagaaatatgattagacataaagagcataatccaatgcaatagactcagtggggaaatacatcaaagcctctctgtctagattcttctaggcctctctgaacatgaattcctttcttctgggtgtggggcatgaccctctctggaacagagatcttatgacctgcagtcaaacaaggtaggtcagatcgtttctttgtggttagtttatacacagaaagacagagggaaagttagagtaatatttttaggtttcatggctggatttggggagaaggggtcggtttctatcactcgtcttagggaaaagagattctaggttctgtggctagcctccagggaggatgggattgagagacaagagggcaggagaaggtcagagaataacatttgcttctgaggccttcattttggggtactgttttctgagctccaacactccagtgaggtgaggtacagcaaaaaccagaggccagtatattctttaaaaatatcaaggtcatgaaagataagaaaaactgagaaactgtttccaattaaaggagactgaagagatatggaaactaaagttaagaattcattcatatttggatcttttactaaataatttttgaccttttgttctaaaggttgacattgggataattggtgacatttgaaagaggtttttagattagatcataatgttgcatgaatattaatttcctgattttgataattgtggttatgtaagagaatgctcttgatttttagaaacatgaactaaagtatttaaagataaaggggcatgatctccatcttactctcaaatgattgagaaaaaatagtgtgtgtgtgtgtgtgtgtgtgtgtgtacagaaaaagagaaaaggataaagaaaatgttgcaaaggttaacatttggggaatctgagtgaggagtacgtggaaattccttgtacttacatttatcctttctactaacagagcttcagatgaaaatcacaaccctggccaacaccttgatttcaatgcaatgagaccctaagtagaagattcaggcatactgtgcctgtacttctgacccacagaaactgtacaaaaataaatttgtgtgttttttaaaagtgaggccaatggtgtgtaagaagaatttgaagtgggaaaaaagggtagattcaggagacattatggagagaaaattgccacaatatggtgttttccttggctagatatgggtagagagagaagagttggggatgattctgaagttgggagcctagaaattgggataatgctggcagaaagaggcaaatagagggagagctgggtgggagaaaaaaaatgatgttttagaaattctgagcttgagtgaacagaggacatgagtaaaagggaaccatctagtggaaaggaattggttaaggattgaagctgaacagagaggtcagggctgcagccagaggtttgggaggcatcaccattgttttggatgtatttggaatccctgttgtaaagggaagaaagaggctgaaaatagaacgatatatttgagtccactcctgcacaccaagttggttgtgaggacttgcactgaagacagacagatctaggtttaaatcctggctttgctcatgcctagctctgtgacgctgaacaagtgcctaaacctctctgagcctctgcttttcttttattcagctatgaaatggtgacactgatcatacctgccttgtggtgaggactaaatgagataacctatatataaagcacttagctcatcgcctggaacataggttgcgctgaagaaattggggttatgattgttactgttgtttcctttcatgtgattttctgcattaggcagccttctcccgaaaagaaccctgacaattcagatcactgtgtgttttgttttgttttgttttgctggtgggaatgaggcaaggcgaccatagcatggcatcttttgcttatggagggcaggtccacaacctgttactgaaaagggtgaactttttctttttctgtcaatacgggcagatgaagagaaaagcacaaggagctctaggaagggaaagttggagctgtggctaatggagcaagggcagaccccaaagactcatctagatcatcagtgatgattcattcctccgaagcctttcctaggccattctgagaaacactggaggaagtgggatggcatgatctagtgtgagtgatgggcactgtgcacaaggggatgatttgtatttatgaaaggttcttggtgcctaggctgcctgatgcatgtctaaaaaggcagtgggttccaagtcaatgtgcctggagtgaggagatttagcttcacctgctggcactgactttccctacagaagatgtagctctgggcaccacactcctagcttacatttgatccctcctgctgaagcagtaatcaatctgcagtcttctgctattagatgttaatgcaatcaaagagatcacaatgaccttaagatttcctgattaattcactttttcccctagtcagcattaccttctttaatttctcagcacttggctcgttttctcagctcacttggctctgtttcatgctacaagtacctttttcctctactgaggagagggtttgggtagagtgatggcgttctgggctgcctggtagtggaagatggagaatccctgtccttgaataaaggtgtactacccaaaaagaaaggttttggggttttgacaaaaagcaatcttagaaaaggacatttggaaatggtaagagaaagacagagagagagaggatgtgtgtgtttgtgtgcatgtgtgtgtatgtctgcgtgtgtgtgtgtgtgtgtgaaagagagagagagaaatcttgagaaactggtaggaacaaagtaaaattattatttcctctcaagtcaaagaaggtacagaaagaaaactgccgaggtgaagatacgtatcagggattaccaattttccagagccccccacgcataaagtgctttaagatcctcagtgaggagaagcttaagatacagagactgatgatctgccaccataggtgggcagctggagttgatacaagctgcccaaagcagaatttgtgatttttttctgcaaatacattcctcttccagtcaaccccactcagtaaatggcactaccgctcacctggttgcttaagtcaaactcctggtggttatcctgagttcttcttgttcccttacacatcacatcctagtcatcagcaaatcctgttcatttaccttgaaaatatttactgaatttcatcacttttcaccacctcctcagccattagctagtgtgagccaccatcatctctttcccaaaccactgcaacagccccctaaataatctacttgcttccgctcttactgccaggcctgccatgtatggatgttcaggttgtatactacacaagggcaccatagctatgggtgtgccatttatatcacagacacatacatacttacataagattgtgcagatgggtgcagacattctgggcttcttggctctaagtctgacaacagcggaagagagcctgctcctacttaaaactgtaccagtgcacatggccttgcatagactcaggaaagcacaatcacacacacacatacacacacatatacatccataaatgtacatactcagtggcacacacaagtggactctatcctacccaagccctgggtgtcccctgagtttacttctctctctactacccattgttcccacaggctgaagtcccatccctcccacttccagctgcctcagctggagaggggatagaacagtggggggcaaagtgttgttgatggtgcatctattccagtgacaagaaatgcatgagtgagaggaataatgtgggtgctcacaacacaggctgctgcccaccatgactctggcaaactttcttgggcaggacttaaatttgtttaggttgtacaagaaaagactaacataatttttgttgtcatttttaaaatgaggaaggggtgtcttttttgtgattcacacagacactgtatcagatagtggcagccttacgcccccccgcccccgccaaatctcaactccaaccaatctctactctatataacagtcactaagaactttaacaaacaggctgggtacaggggttcaagactgtaattccagcactttgggaggtcagggcgggcaaatcgcttgagcccaggagtttgagaccagcctgggccatgtggtgaaaccccatctctactaaaaatacaaaaattagccaggcgtgttggtgcacacctgtagtcccacctactcaggaggctgaggtgagaggactgcttgagccctggagatcgaggctgcagtgagctgagaaaaataaaaaaataactttaacgaacacttgagtatgttgattctttgcttaaagccttccatttatattttaatgtttttaggataaagataaaactccttagatggcctacaaagcttgaatgatctggcccctgccttcctctgcaacctcatctcatatcaccctccctctcatgactgccccaaaccccacccacactgattttctgtcccttgagttcaccaagcacatatcattgtatttcttgtttatctgcctcccccttcctcctacctccctgcttctagagtgttaactctgttaagcagggactttgtctttttcatcattatgtcttcatcacctagcacagttcctggcatttaataggtggtcaataagtatttgctgagtgaataaataagtgaacaggaaaatgagcaattttgctccctattccactcattggctctaagatgaacctcagctcagcctcatctctagtgtgctttgagatcctctggtgaaatgagatggccagaaaatgcaaggttgttaaacatcagaaagttgcaagaccagtttggtcaggaggaataataatcagtataaccagcacgtattgagatattagcatgtgctgggcattgctctaggcttttttctcatttaatctccacagtaaccttataaggtatttcctagtatagaattatccacatttgatgatgagcaaactgaaacccaggtgattcagtgacttggatgcagacacaggcagttcgattcaaagctttcttttgtgttgtgtgagaatgagaacagtctcatttccactgatttctttttcaaaccaccctaggattatccctctaccccctggcttctcttcaatctcataatcttgaatccagccctgaggagcaggtagaaaagagccatgtactacattggtaagctgcagtgagtgtaggtctagttagtgtccccatagggtagcagctactttgatgattgacaatataaatttaaaagctgagatatcctgtactatcttgatactgaaatcaataaaaccatcaaatcctaagccagcctcaccaaactaaaagggagttgcaaccacaaagcaaatttaacacctcttggaatctttctgacatcacatgaagcactacctctgaggtgagaatggcattagcttgaagctctacagggctgaaaccttagctattacagggctggattgtatctgccaccttcacatgggaagagaaattgacatggggggaagagacaactgactaggcagtctttgcagctctgactgtgcataaagagaatgaaaaaataaaagaagagagggaaaacacagcataatcctcattgttaagatgttatcatgctcatgggcataacagaaattactgttcttcatctcaccttatgattccctttaacaaaagacaaccattgaaaacacaatttgaggccagtttaccccttcatgctcagagcctgaatcacaaattcatgggctgtattaaatgctttccccacttattttatcagattcttagaaccagagaaggaacctaatagaatatctggttcaactcattcacattttctagatagggagactgaggccaaaagaaaggggtcttgatttcattttcaccaagtgtacgcgtgtgtgtgtgtgtgtgtgtgtgtatgtgtgtgtccattcgtgtgttgcatgagtgggaggtttgcttcaggagctgttaaggggagagatggaaagttctgtattctaaaaggaaaggggtgaaaaatgttagaatcaatacagtgtttggtaaataactagtaatttgtcacataaacatatacacactacaaacaccactgtctgtggcagaaacagagggatgttctcaacagagggagggtctcagccaagaaggataaatgagggccattcatcctttcagaccctttctgccattggcaaagattggtccagtccactgcctaggttttctgtgggctctcaacattttgctcagcagagacttcccaaggctgcttcactagtggctggtggcatttaacctctgtgggagggatggagctttttcttttcatcatggaatccattatttttctttgaagcatagtgcaaagcttcttacaaattgcatggcaaaaatagaaatgcagccagttctcagcacagccttgtggaagtcggggcaacctgtccctcaggcagtgtggatggagagtgtgttcatttctgaacttgatggtaaatcctatggggaaggaggcagaaagcaacccatcccttcctcttctcccttaaagggaactagacctaaaatgtgttggagctgtgagccctggagaaagccagcccaattgcagtattagaccccgccagagggagtcagagtgtggcagcttggctgtgaacttgccgtgagacctggagtaagttgcttcccctctttgggtctctgttttttcatttaaccctcatgcttcacagaatgattgaaaggtacaaatgtagagaaaatagacccacatatgctttggaaacagtaaaaacctgatattagtacaaaatatttttattgtcattgttttatgtctgctctttgtctctggtggttgacctggaatttgggtatctgatctggaatttgacttggtatagaatatttcaggataggttcaaggcctctggagctgcagaaagaagaattgttggaagagtcaatgcaggttgaacactgggctcaaacagacccctcacaaatcacagccctgctccttcattaatctccccgggtatgtcttccagcagcttatcgaacctctgagcttcagtttcctcatctctaaagtggggttgttgtgggaatttaagtgagataataaatgaaagctattatgctgaagcactggtgtggagtatgcatttgataataattctttttgatgttatttgcatctgtgtgctgagaataactgtgattccttaatgtcagtgcacagctagtccttgttaaaacatacagattcctgggccttgccctaaagaaattctgattccataggtttggaatggagaacaagaacatgtgtttaacaaggactccacggtattctgatgtgggtccaatttggaaaccattggtgtagagcactgttattcaagctgtcaattgttacccactgctcagaaaatcaatttagtggatagtgaccagcattaaacacacatacaggaatggaatgggaaataacagggtacactgcacacagtaagggtaaatattgagttataaaatgtttataattacatataattttaaatataaagacagttatatttatcatttataatatagttgtatatacatcgtttgtgtgtatgtgtatatatatacatgcaaacatttcatgaggcaatacttaccctcactgtagataccttgacattggacaaaattatttgaaatactcatttcttatttggagaaactggcatccagagaattaatctgtcaagtctcagataagacaagaaatgaccaacaagggaatggagtaggatccatttctcctctctccccatctctcccatgctattcttggatcaacagagttggtggttctctaattagaatcagttctaatatcatataatggccctggcctgaaatgtaagggcaagttagggaggcggctgcaggtatcaggctaatggcattgaccccattagacggaaaatgcatctgggtttatgggatgtttagctgctcttggttagtgaaggctttgtataagtgtgccaagctcttgtccaaacaactgctcctcctttccttctcccagactttgatattgattttaccatttgaaactcttttgttgcctctgtaaaatcaaataattagcttaaaactatccttccggtcacatcaaccagcatcatcttttcagtcctgacttgatatgttgaagatgttagcacccctaacctttcatccacatgctctgtctaaagggagcagctatttctgggttccagttcattatggtcctgtgggaatgtggtcactttgccagtgaggccttctgtgtctaccctctgtgatactctaggccttgcaggaacctactactcttaccatttcaaaactcttcatctcctacctgactttgtattttcctgatggtacttatcatacaacttaacatagtatattttaaataataaacagataatgaaaataatcccatgtgtccagatattttttttctaggaagattgaaaatcaaattttatgtgaagttttccaatttttaatgctgccagatattttgatttttctagagagcttggacatctgaatattcatgtaaaatcttgtaatttttcaatgtcggttaccagttcatagaaaatttaaatactatttgcaccaaagaaaatatgtttgtgatccagatagagtccaaggttcaccctattgtgatctgtgtcatagatctgtagaacactggcgctgtgagaagccttgtaaattggcagcttctaatgaggaagtacagactcagaaagattaggtatcttctgcattatcacacagctggcttgtagcagaactggatctcgaacccagctttcctgcctcctagttgctctgtcatagtcaccatgctggctgcctcccttctgctgagggttgagttaatctgctctgtgtagaggacagctttcagtcttcagtcccctcctcctaaagaatataacagacgcatcaccacccatctgataatccccaggcacttctcaccagagtgtatgaatttacctgccttcccaatctcaactgaggatattgcctcttggcgctctttattgcttttgctccagtgatagaatcaagacaaagtctttataggaatgttattatcattgctcccagacagcggtgtcttccggcagagtcatagagtcggtgtggtctaatgcaaagaatctggggctcaaagtccagacagctgggctcaattctcagatatgtgacctgagacaacttatttagcctctccggcactcaatttccttaactgtaaaaatgagaaaaataagatctgtctctcttgtgtctcagagctgctgtgaggctaaagtgagatgatatgtataagagcaccttggaaacagataaacattttacaacgatgagggtatagtatcattaaatcagcaaaataatgattaagcacctactatgtgacagtgaacataccatttatgcagggcatgccaagaagcataggcctatctgcctccatgagcttatagtctacctgagaagaagggacatagctgagtgggaagagagccagcactgcaaagctagagaccagggctgaaggaaatgtattgaccgtagaatgagagaaagaaattgtggtagaaaggggtgaccatggaaggattcctggagggagttgcatttaaactaagctttggaataaaaattcacaggctagggctggcaggagttaaaaaaaaaaaaaggatattcttttactggtcaggggcaacagcacaaataagggctgaaatcacaacgtatgctggaggtctaatctacatggacagaagggttcaagtagtggctctcagattattgcttatccagctttttcactggcctaaaacacaaaagagaaagtcaagggatgcttgctatgaagtcaaggtggggccaggcacggtggttcatgcctgtaatcccagcaatttgggaggctcagggaggcatattgcttgagcccaggagttcgagaccagccattggcaacatagcaaaacctcatctctaaaaaatacacaaaaattagctgggtgtggtggtgcaggcctgtagtcccaggtactcaggaggctgatctgggaggatcgcttgaaccctggaggcagaggttacagtgagccactgagattgcaccactgcactccagcctggatggcagagccagaccctgtctcaaaaaaaaaaagaaaagaaaaagaaaacaaaccaaggcagaggttaagtgtgggcacaggtttggttaattacatcacaggagggcctaatactataaaatgatcataatgattatttctgcctcatagggcttttctcagctttaaattacatgatgtgtgttaaacatttagcatagcacctgatacatgattagtactcaataaatgttagctatcatcatcatcaccagttttcatcttatactgaagttaggggacaataacatgggctttggaatctgtctaatattagttgtgtagccttggtcgagtcacatcacttcctcgtttctcggtttcctggtctttaaaatgggaatgacagtagtgccaactgaaaagggctattgtgaggattaaatgagttaatccaagtaaagtacttatcaccatgcctggtacatgataagcattcaatagatgttagctgctacagttattatggccagttgaccattaaggtaatatgacagcataactaaaacatgagaaaattgagaaaaataggcaatcatgccaaatcttactactaagacacatcttgttattatttttggatttggttcttaaatttaaaatttcttttgttgagaaaatcaagactgcaggagatggcatggatttgggatgcagcaggcatttcgttaaacacttaataagtaactactgtgtgctagccagtgttccagaagctgagatatgacaagaaaaaaaaacacacaggacaggcattattcctgtatttaaggaatttatagcccaatagaggtagtatggaaaacaaaataataaatataaaatattgtgttatgtgatattaagtactatggaaaatatcttcagatggggtgataaggagttgtaaaatggtcaggagtggtgagggagggttggagagtgaaccctgcagagcctataattttagagggtggtcagggtaggcctcaccaagaaggtaatcttttgaatccagccctaaaggaggtgagggagtaggtcatgtaggtatctcagggaagagcattgggagcagagagaacaggaagagcaaggtctttgaatcaggaggatatctggcatttatgaaactgccaagaagcccatgttgcagcaatggagtgaatgaagggaagagtattgggatgggaggtcagagaggtcacagagacaagtttgttaagggcattgactgccatttccagggagtgagatggaaagccacggaggagcttgttcagtgaaggacatgacccaacttatatgagctatttggcactcctataagcagtgggttttgaccccatagatcctgggcaataataaacaagaggcagcaactccaccattccctcagaactctccttaccactctgtagactgcagagagtggacttattgatcctgagggcgacacagagaggaattgatggcacggagaataggggaaaaagatgtaatctcttagagctgaaagggactcagtgcaattctgccaccgggcatctgttcattccgcctcgactaaaaccgtcactgccttatcagcttgctcagcctcttcttgcaggaccttctcaaggtcggaaagccttttgatgggtttactgaaaatctgcctccttttcaccaccgggtggcagtagtcctggttctatcacctgagcaacccagaataagtgcataccttccgcaggaaaatacttgagatttgaaggcaggtggatatcttatatatcccccaacgtttctcctttacaggccctattgtctcttctaccttcaagagtaactcctattatagaatggttttcttttgtcaatcttgcaaccctcttctggaggttttccactttcttagtgactctcttaaaatgtgatgtctaaaattgaacaggagacggcaggagtgaacagaggaggttacagtgcaatgattatattctaggatctagaaactgtactttgattatgcaatctaaaattgtgctctgtttttagcgactaaataatttaggtacattaaactgttggctcgaattgtgcttgtgggtcaattcaagccccttgatcttttttagtttgtttatttgtttgatgtgagttgctgtgaagccacacttcccctattttggcctcacaaaatggacttttaaaatttgaattgatgattttttttctttatctcatttatatttcaccatttaaattttagcccagtattccaacccgtctgagcttattttgaatctcaattttgttcttcaacatattccgacatccctgccaggtttgagtcatcttaaaacacagtaagtacattttctgtatcacctaagttattaataaaaatgaaaaagtcttgtggcccttctctggagaacttctgctggattgccaatccatttgactgtattataacttgatcaatatgttactatcttgctttagttcattcatgagaaaattctgagacaaattcaaatgcatggctaaatccaagatatgttgtcaatgcaaaagatagcatggatgaaggtgatctaagataggatgtttttgttttgcaaaatggaaattctagtattgttttttccaattataaggtgatattggcttgttgtaaaggtcaacagcatacataagtatacaaaatacaaagggaaatttcctctgtaattctgtgcaccgacactgtactagataactatggttgacagttttatgcatatataaacacagatctatggttttactgggatcatgatatagagactgttacatgacctgctcttttcacttacaatcctttggaaacgtctgtccttctcagaaagtacagttttagctccttcttttaaacaatgatatagtgttcttttctttggatgtttcataatttatctcatcaatctcatattgatgggcatttagatcattggcaatttttgccgttacaagcagtattacatgttgaattgtctttgctgactcgatgagatgttgtgctagatgctggttgttgccttctctgtatttcccatcctcttgtccttctcagatattgttgtcaatgtcctaaatgccaaagggctgcttccgcctaagaactaatgagggggccaaattactactcatcatggtttgagtttgaaaatctatacttgccctactttcgagtgtgtttaaggctttttgagctgccaggggcttttagaggatcaaggcaccccaagatcaagccttgagggacagacagtcttgataggaggctgcaacccctgtttggcacatgtgaagtggttaggggcagaaaggagaaggagaactgccttgccattgggccacaattccttgttatacaccctcagccctgaccaagcaggacacttgctggtccctgaataagctcctcctttttcatgttcacacctttattcctccacagggtcttcctcctttcacacgtgtacctcccagaacaaggtaggagccatctgctctgaattcccagaatgctttaaaaccatgggcttgggagttgaaccaatgtttgaatatcagagcttggcagttgaacctagctctgtgatttttggataagtcttttatcctttctgggcctagttatcctcatctatggagtgatgatatgcctatatattttgaaacacctagcccagtgcctggcttaacaaacgtttgctgttattattatcataattaccatatgtgattatattacctactccactgttgtgaaaattaaatgagaacatatgtaaagcacacaacacagtgctcagcctaaaatgggtattaaataaattatggcaattactgattgtattcatatcttcctttggatacttatcttactctcttgtgttactcctatttgtgtttacgtcttgatctcctcctttaattaataagttccttcaaaagcacagtgtttgtcctcttccctcctcctacccctctcccctagaaagcataaaaaaaccagtgttggggttagtagggctctttaaaatttaggtgccgtcagcgaatgccaccatcactttgtctaagcccctttctgattggattttctagttagaaagcactgtctcattaacagatcaactgggccccctttctagggcaagtcatggcatacatattccaacccctgagccactgatcagaattagcaagctatagaatcttagctttggaaagattttcagaaaccaatggctttgtgtatgagtttacctgggcagaatggattcatgtaccactctcaggcctttgctatctagatggaaaggaacaacattaggccattagcccagtccagaccactgttgagtccctcttagactaccaaaacagtctcctaggctttttcctgctttcgctcatgcctctacacagcagcaagagcaatctttagaaaataaaaaatcagatcacatgatttccctcctcaaaaccctcccatggctcccattgcatgtagtataaattcatatttccttcccatggcctagaagaccctgaataatctggctcctgtgcatctctccacattcatcctgttacactcttccccttgccccctgtgcaccacctgcgctgatctactgttctgaggatacaccaagctcatccctgcttcagtgcttttaatcttgttttgaccctctaccaacaattgaatgccagccttgccccaacttccccatgtttcttttcgtccttcaggtttccatttcaattatactttctcagaagaacatgaaaagccttccctgtgcaccctgtctcaagtaggttcttgtccccacgttattctcaaactcattggttctcaggcttgcttcaaattgagaatcactcagagagcattaaaaaacaaaacaatggccaggcctcttctagatgaagtaaatcagaatttctgagaatggaactcagctatctgtatttctaaatgctcctcaagtggttttaatgtgtagccaaggtggacagcctttgttttatctgtcaacttgtttatttcattcttggtgcttatcacaaactataattattttgcttattttagcaacttatttagtaaatatttattatgcccctacatgtgccaggcactactcaaaacatggaaattaaactagtggacatactaaacacaaatcccaaccattatcaaacttcaattctagtggaggaggcagacaataaacaagatcaataaaatatatagtgaaatttttatagtgttctagactaaatggttgtgtcttccccaccaaattattgtgttgacatcttaacacccaatatgatagtatctgaagatgtggcttttgggatgcagttagggttagatgaggtcatgagggtggggctttgatctaatgggattagtgccttgataagaagagacaccaaagagcctgctctctctctctctctctatctctctctttcccccaccaccccaccacccaacatgcacaaagaagtcatataagcatacaatgagatggtggctgtctacaagccaagaaaagaggcctcagaatgaaacttacctttctggcaccttgatcttggacttccagcctccagaactgtcagggataaatgtctgttgttcaagccacccagtctgtagtattttgttatggcagtccaagcacattaagacatatagtatgttagagaatgatgagtgctagggagaaaagtaaactagataatggagatataaattttttggaggagagaaacactttagacagagtgacctcgatagataaatcttgagtaaagacctgaaagaagtgacagatatagatctgcagctatttggatgacgaacttttaaggcaaagaagagtctgtgcaaaggtcctaagactgtatcatacctagtatgtttgaagaacagcaagggggccggtatggctggaggtttgaagacaaggggaagagtggtaggtgataaattcaggaatttaatggggttgggggggcaggtgtttggaactttgaaggttattgtaagagctttggcttttactgagtaagaaggggtatcatagagcagagggtaatatcatctgacttagattttagtaggcttactatatatggtatgttgagaatacactgaagagggaaaagagtggaagcagaagaaccagttggagactactgtaataatccatgtgagacatgatgggggctcgaagaaggatgatagaaatggcaatgatatgagaaccaataagaaatggacacaaactgtatgtgttttgagagatagagtatttaggatttgctgacagacctataaataggacatgagataaagtacccagtcaaggatgatgccatggtttttagcctaggcatctataataatggagttgctatttacctgagatgggaagaactgtgggagaagtaggttttaggggaaatatcaaggaattagttttcaacttgttaagtttgatgtgcagctgtggtctgaaaatttgtgttctccccaaaatttctatgttgaaatgctaacccccaaagtgatagtattaggaggtgagagctttgggaggtgattaggtcatcacggaggagcctctacgaatggaagggattagtacccttataaaagagacctgagagtgaccattcactccttccactacgtgaggacacagcaagaagatgccgtctatgagaaagcgggccctcaccagacaccaccagcaccttgatcttggacgttctagcctctgaaactgtaagaaatacatttctattgtgcatgtgctatccagtttatggtatttcattatagtatcccaaatggaccaagacagatgcccattagacatccaagctggagatgtcaaatagagaattgaatatacaaaccttgaattcataggagaggtctggactcgggtcagaactttgggagtcataagactgaatgatcacttagagaataagttcaggtagaaaagagaagtccaaggactgatccctaaaccactccaatgtctaaaggttgggttgaagtgcaacaagcaaaggagactggaaagaagcagccagagaagaaagaagaaaaccaatagaatgtggttcctggaagccaagagaaggtgattcaaggaagagagagtggtcacttatgtcaagcactgcagatagctcaagtaagatgagaactgagaattggctgttgaattttgtaacataaaggtcactggtgatcttgatcagagcagtgataaaagtgagttcaagagagaagggaaggagacaatttggagattataagtataaacaaatgcttcaaggttttagtaaaatgaggaggacagcaatggggcagtagcagtatctagaagaggaattagggtcaaaagagggtttattaacttttttaggtaggagaaaaaatattcaaatgaaaagatccacctcctgcattagaatgtaagcttattgagggcaaggactttgtcttgtgcatattcagcaccttctatggtccctagcacatagcaggcactcaataaattttgttgaatggtgaatgatcaaatgaatgaagaaatgaataaataaacaaaagtagatgtcaatgagttgagcaagaaatactagcaggatagagtggcaggtgaattgagtagcaccttggctttagttctagtcattcctgccacactcctggcataccaaacttatcccaggcccagacggcttgtgaatgagttggcatggcacaactccctttgctaagagggcatgttatatctctgtagtcacttgttccagggagcagacaggctgttggactgtaagaatcaggtgcagccaggtgagactgtagagtccaggagtgtgccaaaagagatgcccctttgcatcatcaccattctctggtcctgatctgtctgtgatgcaggacatgggtgagacacatgctgcactggcatcccagcctgctcttacttgctggagggtagttaataacctcatgtaacacaggccaaggagcagctaaaccaaagtttaagaagaagaaacacatgcccatgcagtgaccagaagctttggcacccggctcatctcagttgctgcattgcacaatccccacaatttaaggtgatgggttggcccagtggggctcttgcatggtgcctatgactcagtttttgctagaaagatggcatggccccactccaggctggcacataggaggtgctcggcaagttttgaataaataaaccccttgggactgaggaaagaatgcttctttcgctttgcggagttcttcagtgctcagccagagccagattgtgaatctaggcagtctggcttcagggcctgtagactcagccacttaatttatacatgcaaggtattgggttttattgggggagtggtggtggtggtagtggtattattttttataaaagtaaaaaaaaaaaaaaaaagccaggtgcagtggctcatgtctgtaatcccagcactttgggaggccaaggcaggtggatcacttgaggtcaggagtttgagaacagcctggccaacatggtgaaaccctgtctccactaaaaatccaaaaattagccaggcatgttggcaggcgcctgtaatcccagctacttgggaggcacgagaatcgcttgaaccaagggggcgaaggttgcagtgagctaagatcgcgccactacattccaacttgggtgacagagtgagactctgtctcaaaaataaatatataaaagtttttttaaaaatcttgctatcacattatccaaatattatatccatattccctctcactggggcacatactacttgggttcctttgcctattattgttttgctttttggtagagaactcctaccatacccaaccatattaccttccccttcttcaaaagagattcccaggaatcctaatatcccacagaacataatctttccatttccagaaaggaatatggatgcctgttggttttgtccctttgtgtcttcacaagtactgagtgcctaccatgtgtcaggtcctgttttagtcaactggggatatagcagtgaccaaaacaattttaaaaaatcccaccctccacaacatcacttccatagcattcttgccaaaaaatgcactaccttaatctaactgtaagaaaaaagcagacaacacctgattgagggaaactctacaaaatagttggcctggacttgtcaaattgtcatgagagacaaaggttgaggaagcatcacagattagaggaggctaatgaggcatggcaactaaatacaatatgagatcctggattggatcctagaacaggaataggacattagtagagaaactgggaaaatgtgaataaggtctgtagatgagttaatcttattgtatcaatgttaatttcctggtttcaataatcttagtattattatgttaaggtgttaagattacaggaagctgggtgaagggtatatatggtaactctctgtgctatgtttgcaattttcctgtaaagtctaaaattatttcaaaataaaaaattaaaactagccctgccctcctggggcttaagtgctggaattgacagccagagagagaagaagggagggagagagagaaacaataagtaaaacaatcaggatattatttagtatattagcaggcaatggatgttatggagacaaagtaggaaagggaaatgaggagtagaggggctgtattcaagtaggatggtcgtggaaggcctcactgagatgacatttgaacaaagcctttaaagaagagggtgcaagagccacaaggtagagcacaccagtacgagggaaatgcaaaggtgctgagggcatggaatgcctgcccagtttaaagaaccacaggaagcctagtgtggctaaagcccaatgagcaaaatcagtttgccgcattctgtggttttaaaggtatcggaaagagactgaccacagaggaaagattagggaagtcaaacaaaggacatcaaatggaaggcctgctgttgtcctctgtttccaaccaagtcacagatgacagaaacatgaagggaaggaaagagcagggaagtaaaatcgctgaagtctagaatcactgtccaatttctggtgagtaaatagatccttattaagcaccataacaagtttctgagtctcctgtgttttattcctctccaagcactgaactataattaatgctgagtgtggcactggtatcacacagcctgtgacatcttcctgattttgtgctgtgtaaaatcatgagaagtgtaattggtagcacaaacgggtgggctgatttttcttggactaatgagtggaaatgatgaaaaatccagaacatttttttgatttggcttatgtttattatcaaaaattctcgacttattcaggtagcatcacttggatgtttgaggcctggtaatgcatgcactaaacagtatgcagtcaatgatgttgcttggcaagcagccccctggcctgatgtatacttacaaaagacaggccaggtaccagcggggtttcctaagggttcctcagctggtagctttgactgaggatgcttcctcttcaccaactatgcagaagcagatatccacatgggaggagccagcctaattcatgggaggcttggtgacagcaatgttgttttaggaacatctttgaccagtccacacaagagtgcttaaaaaaaaaaaaagattgtatgagaggatttagtgcttagtattctgaaaagtgtaaaatactgcataaggtattactataataataattattattatgtactatgatgaggtttaaagaaattaaaaggtctatagctataatgttttctagttccttacttgtttagtgttatgaaggatgccattaccctctttttagaaaggacagctaccattttgagcacttactatgtgccaggcactataataaatgccttgcatgtattgtttcatttagccctcacaataacaccatgaagtaggtactgttgatatccccattttaaaattgaggtaagtgaggctaagagatgttaaataacttacccaaggttgcacagtaagtggttagaaccaaaattatatgcaggagattggctctagaattctgtgtccttacgtctgtgctacagtaccatttaaaataagggatgcaggacacacatgctctgaaaaggcagatttaggtctccaagagggaaggcatcagctctgcttttggggctccatacacaaggataactgttaagaaggcccgaagcatgtggggcagctggagctcagactgatgtacttggatgtctgaagaggtgctaaggggctatctggcatcccaacttgaaagactgagctaggatgaagagcaatggacaaactctgaattctagaactacccagaatagccgtcacccacttcaccccatccttatgtctgtgaggaaactagagaggcagagcactgctgacacgtgcccaaggtcacacggttctctagagccagcagctgcagtagaactctggtcttcaggctcccagttcagtgctcatcctccaaccccacccccattagcccctcgcattcagtgggcagcagtcagaaagaaggcatctccttttgagtgaagctactgtctggagcagtggttctcagtgtagcccagggacctgcaacatcaacatcacctgggaacctgttagaaatgccaattcttgggtctttccctggaccaactggggctggggccctacaatgtgtgctgtaacaagccctcttgatgattctaatgtatgctgaagtttgaaacccactggtctagactgacaagcaaagcactgagtgctgcagatatcaatatgcatgtggagcatcaacttgcacagcacaaaggatagtcttcatagggaaggaatgtggaaaggactgcagccctcgagccacacctgcagcacagtgtcaccttcaaacacacatgatagtcacagatagatacacagagactgggagggagggtgtagccagtttttgttgatcttcagctgcatcaaagataatgtagttttgccagctcagcagttcgctagagacatgccagctactcggcttggtgctgtggaaggtgaagtccctgcacctcggggaaactgccacccaggattatagaacttccaaattgggagggagcttagagattatctactccattatccacctctaccactccttggtaatggcatccctgactggcactttctcagcttcagcattacagggccatagtgagagtgagctcagtttcttttaggacagcttggaggtgggagggagaagggaacttacacacaggtaactaccattacaaaaagtagtataagtgttagagccaatgctgtaagaacacagagccaggaggaatacattttagctgtgggagatcagggatgacttcatggaggagatgtcctttgagctgggcaagatttcagcaagcagacacagtggagtaggaggggttatttccaaagaagacaatatcatgaaaaacacttgaaggaatgaaaatccagaacaaatttcacaaaactatttaggcaggctaggttgagaggacacattctgcaacgagactgcttagcttaaaatactgactctgcaacttactggccacttgactttgggcaaattattgaacatctcttggcctctgttttcctacctgtaaaatgaaaataatacaacatacctgtgctatatcatattgggttgggagaaagagtaaatgagataatgctatgaactagctaacacagtgtctggcatatagcaagtgctccaggacagtttggcaagctttcttcatatataacaggaaatttgtttggagcactggcaatagaactgagagtagtggaggtaatctttgatactaggttgtggagagagcttagagtgccaaactaagaatttggggcttttattctgaaggcaggggatatgcgtagtaggaggatgaatgggaacagcggcaagggatagagagagttaagaagccactcgatcttacttaaggcagtgacaagttacctgaaaggaacaggacgagaatcaggttcagaggagagatatttgtgtgagtgtatgtctgaactatactgtcacatataaacctgactttgggttaacagcctgaaatgtacacatgtgtctattaaataattggagaataaaaattaatggttggagagaatattcgtcatttgttctattgtgaaagacaatcctttgttagctcgagtgaagctatgtgaaatattatatcctatgaaaacacttcctaaagttggcctttttgtaagaaaatttgggatatgtgcaattcacacatacttgatcaatttaagcacattctgttttactggcaggcaccaaaatctgtaataagacaaggagtcctccagtgaaagagatgattagagattgcaatagcagtgcacactgagctccaattaaggaatttcctaatggttgtctaggaatacaagtgccctccatttgggctttggtgataactagagtattctttagttgttaatcagagtgaacacaattcaaaatgttctcgactcgtgggtcagagggaatgatctcatttggcacattattgagtttctgagaagaggaaagatactaacagctcacaaatattttgttattgactaactgcaaagatgcatctgttaaagcaatccatctgagttggctagttctctcgaatattaaagaatatcaatatatactaaaagcaagtcaatttgtcaagcatttacaaagcaactttgaagccaaatgataccttttctgccttcccttctcttctagaagatactcacaaacacatacaaatctggactaaattccctctaacagaccctttgtaaagaaagctcactttctttggctgcagtgacacagatgtttgggtgggagggggtgcggagggtggcggaagcatgctggttcaatgcttgagaaacagtgctgcacccaacagactgaatgtcatgaattctttgtcagctccccctcagaccctccaggctttccctttgtctgctaagggatggaaacagaacagatacattgaagccggtagactgaccagctagattgacccaaattcattcaggaaatgcaaaagcctgctggctcctgggattagctggctggtgtttgaatcgctacccatctgtacatttccttctagtccagtgcagccccagcttgctacatctgctcacctcagcagcttgctttccaagacaagataatttgagaagagtctagttgtgagaaagcaatgtccaatgctagggaaactttgtggcaagcccgaagagaaatttggcccttatggtaagtgatttgctatatccccggtgttcttttcccaccatctgcccttgctcttctctaattctaggtaatgcagccaacttgtcaggcttagctttgtcgagaggatataccattttcaaggcttcattttttcataaggactgtgctaagcagctgtaagaaaaaataggatgaaaaaatgaatgttttgtttacattagtgaggtggcatcaaaaagcaatgaggaaaggcccagtacatctcatagacagttaattatgtcagaactcagactaaaggagacatggaggtctagacaaattatacccagggtttaccctgctgacaagagttcctatcccagcaatagacaggggtcacagaaaaagcctatagcacagtatttctcagccctgcacattagaatctcttggaaaactttaaaaaatatatatgcagagtcccctccctcagagattatgtcttaattgctatggagttagggccacagcattggtactttttaaaagctccccagatggaaaacaaaattgccacaaaggacatcattgagacaattagccacatttgaatatggactatatattaggtaatataattgtgtcagtgttaaaattactgaacttggtaaccatggtgctgtgattacgtaagaggatgtcctccttcttaggaaatatgcactaaagtatctagcggtgaaaggcatgatgtctgcaacaaactcaaatggattagggagaaaaacacctagaaatgtaaaggaggaataaagcaaatatggcaaaatgctaacaatttggctcatctgggtgaggggtatacagggtttttttggtactattcttagaactcttctgttggtttaaaattattttgaaatacaaaattctttttaaaaaataaaaaataaaacagatcccctgatgaaataaagcccaaccaaatttggaaaccattgggttcagtcaaatagagggaatggggacctgctatagataggtgagactgaaagcctttctgagacattatcctacatcagtgtttcttccactttaatgctcatacacatctcctggagatctggttaaaattcagtttctgattcggaaagtctgtagtgggacctgagaatctgcatttccctttctttctttctttctttctttctttctttctttctttttttttttttttgataagttttccctctgttgcctctgctggagtgtagtggtgtgatcatggctcaccgaagcgtcaactttccaggctcaagtgatcttcccgccttggcctcccaaacaaaatgttgagtttacaggcatgagttaccatgcccccctgagattctgcatttctaatagactccctggtgatgccaatgaggttattccatgggccaccctcagagtagcaattcttggactgaattaccccaccataaatttgtcagtcagtaaacaagtattttggaactgcaagaaaaattctctaagtggagtgggcctgcagagttctatggattggcagccccatcatcttgaccccttgaccatggcaactccccgtgagggattcagaaagtctgcagtggggcccaacctgccctgtgggagtcactctgatccacagaacagaacagagcacctagcagaataagcataaacaaaggcttgcagcaaatggaagaaggtatgaatggtctcttcaaaagcaagtttatgatacaagtcccaggagaagtgcagccctttccagtgggtggcagtggagccaagctgaggctcttatagagagcaacatagttctgatgaagtgtcagggtacaggctgcgtgggtccagctgcctcctccaggtgaggacccctttcttagaaataaaattccaaggaggattcccatttcatgctggctgtggcatgctttgagtttgttgcttccactgtaagtggagaaccaaaatgtctctcacttggaggaccctgcttccatcagaacttcccaaaccttgctctaccatttccccctcaaggtagctcctttcccctctgcctgtgtgttgtgattgtgctttccatgcattgaattagaggctatcctgttatttatatcttccttgtttacatccaaatcgaggccaactagtgtgaatgcacagaaggcaactgagctttactgagcatgcaaccccagagaaaagctctagaagacaaatgagaaaggccctggagttggtcagccctgagtttgtatcctcgctttaccacttaataagtgtgtgaactcgggcaagttacttaacatctctgagctttgggttcctcatctataaaatagggtcaataattgtactgacttcatagagttgtgagtattaaatcaaatagcgagtacagcaagtgctcaagaaatggaagatagtcatggacttgatgggcatttattaagtttcttctatgtgtagacaaagagtagttcaaatccagtctagtcctacttgctagttgtgcaatcttggatgagttgctttgttttacctctctgagcctcagttccgttactcttaagtgacactggtgctggtatataaatcacagaattgctgtaaggaataagtgaagtcagacatgttaaacacatgtcaggcacatataaatgtgctcagccaacatgaaatatcataattgttgtggttatcatgtcagctcttctctgagcacctttgtattatgagatttacttagcagccaagcacactttgcagcctcctccagtagaccctctccaatcttcactgtcatttccctgagggcggaggccctatcctttataccatttctggtgtctccatgacacctggcagtgagtaggtgttcagtgcatgaagcagagagcactatgctgcaagcacagccatcagaagcatcactgcctgggttcaagttttagcatgtccactttacttgctgggtgactttctagcaactcctggatcttctctgagtctccattctctcacatgtagtaagggtgtgataataattcctacctctggggattgctgcaaggattaaagctgggtacatagtgagagcttaataagggttgagtgttttaattgctgttattatttgagaaaagtcttacagtcaaggatcacaggagctactctgagaaatcatgcacacacatgcatagatacacacgagtgggcagcactgagaggacaggttacaggaaagacacaaataggcatttattgcccatgaaaggctctttgaaccccaagccagagccagtgtctgcctaaaattttctctgtaaccatggtactgagagcccctgagggtttttttttaatattgaagtaaaattcatataacagaaaatttatcattttaacatgaagaattcagtgacatttggtacattcacagtgttacagaaccacagctcttctgaattgattacccctttaagctggctgtatccagaggaaggcagggctcattgccttctgtaacccttcttgtcactattccatacctcttcacatccccactttgtttctccttcctcattttttcaattgtactctctctctccactctcctgctctttgggggcaaagggatatgtgtctctgatatacatgtacttttaggaagagtgaggatatttacccactggaaagattccaggtctaaaagatggcactggaagagtgcagaatgggactggtgaagccacttcttgccaggacaggcttggcacacctgaaagcaggcacagcacaatgtcagctgcccattgaccttagtcttcgtggccccagggtcaacagacaacctgaaaaggcttattatcaattatgacgtctgagaatcacagtcctgtttgttatcatgtcttctatctttggcctccccgttattatgagtaaatttgcttcatattaaagcatctattgcagaataaccttcataggctccacaacctcacagaatctgctttatatttgtacctatcggcaagagccacatcttaaatatattaaacaataagaataatactgcatatgtactgaattattcctgcatgccaagcactgcgctaaatgtgtttcatgagttatctcataaatgaatccttacaatgactctaggggccaggcattgttaatatctacttttaatagatcaggaaactaaggcacagagccaatggctgatttgtccaagagcaagtgacaaaacccatgctttacacggctgagtaatattgtggccccataatcccaccatggataattaacagaaaaaaaaatattcatttgcaaccacagacagtagcttccttcatccactgctagactttagtcttggttcatgaacttcctagtttttgacgttaggctgttcacctaacccatctgaaactgtttcttcctctatataattgtggaaattgtcctgccttacctcgctcagatttatgagtataaaatataaaaacatgcagggaatgtttttgcaaaatgtaaagtgctatgccaatgtcaggaactgacatcatgaataatggcttcttgggattatgtgagaaccacccagtttcatgctggggaattagagctccctaggagctctgtgataaccccgggaagctgcaagttcttctagccaaatcaaatccttgacaagccacgcccatttctactcttcatggttgtgtgaactcttaagtgctagctgatatggtttggatctgtattcccttcaaatctcatgtagaaatgtaattctcagtgttggaggtggggtcttatgggaggtgattggatcactggggcagattcctcatgaatggctaagtgccatccccttggtgatgagtgagttctcattctgagttcacataagatctggttgtttaaaagtgtgcagcacctttcccctgactctcttgctccctctctcaccatgtgatatgctggttcccccttcaccttctaccatgattgtaagtttcctgaagccctcaccagaatccaagcagatgttggtgccatgcttgtacagcctgcggaactgtgagacaattaaacctcttttctttataaatgaccaagccttaggcatttctttacagcaatacaaaaatggtctagcgcactagccaacttctctgaactcctaatctgtgtctttaaaatgtacttggaacagcactggaaaaatcctccacttttgatatatccggggctgaataaacccagtgaaagccttataagatgtcttctgcctgttctagttttgaaaaatcacagcctacctatcacagaggttgagatgcagattaacttgaggtgataaatttgaaagtgctttgcacagtgcttgcctcatagtgggtgctcaaaagatggtgcctcttttgtgattcagattgttattcttggggctgggggtggttaggtaggatgccaaagaagagagaggctgcagcaaggggaaggcagtttgggcagttgggactcctagaccacacggcttgccaatttcctgattcctcgaaatgaaggcatgattttgaaacacagctgcctcttactcacacaaaagcagtttatgcacaaggctgtgtctgacttcccatgtaggttatttgtgtttcccagaaatgttgggaaggtgtaggaagatgaagcctaattaagggtcttcctgttccaccacacttcatctccctggcatgcaagtggtttagcagcaaagcaggcagacaaaaagtctctcagcaagaaataacttttattatccctcaatgtagacatgcaggacagtggaccagaaaggctaggaagcagtggagggtagcagtcttttaaatactacatatcattcttttaaagaattattaagtgttttcagaaattgtaaattttccacgtattcattgccctcagtgaaacaatgcacaggaatgttctcctccgttcttctgcttctgcagtgtaagcagtattaacagcctgggttcaaatcctcccacaaccttctttgtgcacatgcaaccttctttgtattcaggcatgtaagacatccataggggattttgctgtttgtactagaatgggattgtgagatatatgtttctctacagcttggcttttgcacttaacagtgcatcacagacctcctagcacatcagtagttatagatctggtacattctttcaaaccactacatgatacttcataatatgaacaatatgaatatgccaggatttattaaactgtacatctatcgataagcacttgggttgtttagaacattgtagtcattctcagagactttttgtctgcctgctttgctgctaaaccacttgcatatcagggagatgaagtgtggtggaacaggaagacccttaactaattataatatggtaaacatatttaccagtgttggtaaatatggtgggaaagattgctgggtcaaagggttttaatttacttatggaaaaattgcttggctgatattcataaattgcattctgattccctcatcctattatcaaaaagtttattgttgatcagttaagcagatttcatttgccttcccaataatcaacgtatgacccatagtaaaggacggttgtaaagagtgggcatccaaggatatgatcttctcttcattgggatcccagaaatggtgggttgtaatttatctaactggactaatttctccagatgccttctttcactgacacaatccaattattctcctgccttttctagccacgatcaccttaggctcaaccttgagaaacaaaaagaaaacaaattttgttggcagcagacatgttttggttctccctcagataaagtttcctttgcaggacaataaaaggggaattggaaaggctggaaaagtaaggtgagcacaagttaacagaagatgaggaacatcaatctgctttactaaaggaattacttttgcaaaagtattgctgaatagtgcttttaagtatcaaggacatggtgggtacatgggggttcactgtaaaattatttcacatttgttttacaaactcttaaggtgttatttttttatttgcatttttttgagacagggtctttcactctgtcacccaggcgggagtgtggtggtacaataatggctcactgcagccttcactttcctggctcaagcaatttttcctacctcagcctactgagtagctgaaatcacagccatgtgtcacagcacccggcttattttttaattttttaaaaagatgtggtctcgctatgtttcccaggttgggccgaagcaagcctcccacctcagcttcccaaagtcttgggattacaggcgtgagccactgtgcctggccctgttaagatgttcatatgtggtttgatttataaaaattctgctcacatgccactttccaggcataaaatatctgtatcaagatactttgctgtgtgtgatactttatgctttttaaagcaatttcatttcacaatccaattctaccctcacagcatcatagtatgacaggaatcactcttctcatttgacaacagagataattaggcctggagaggtaaatgacttgtcaaaagtcacatacataattagcagcagagctaagccttaaattagggattccccatccagcatttgtctcacttggggaagatgggtagaacatgagaccctaattccatctctcattaggtctctgcttgagtcttatttggcctaactcaatttctgttttacttcaggcatgtagatccatgcttctttccatggctaatataacactgattgagcaccagtaatgcactaggtgctctagagactattgaattaaatctggttgctgccctgtagctcctattctgaatttgttggagcccaatctaaaatagttattgctctgcacagatagtacaggcgtataagaacatttctccaatctaagcttgtatctcaccatttttctttaggacccccaacagaatttcttcttatcaggcaggaatatcccacaactggtctctgagtagtcttaaaaaacagccctttattttgcctgactcactcttgaagatgaatgcatcagcttgttttctcttccagaataacatacagaggacagctttctcttctgaggagtcagaagttcagttcgcccaacatggaatgacttgaggtacacttgaatggtctctgtgtccctaaatatcttcctcatcagcagaaatgtcctctttgaagatgtgattccttgactacttcctgcctcttcatgttgtgtcagttacgtgatccattaaccaggctgtatgtatatcctttgaaatgtttcaaacatctttccctttgctaaccactcccacttgccactggctttgttatcttaaacagcaaagtcccagcagatctccctacttagcatcttttcctccagtctacactatatgctactggcaaaattatatttctaaaacaaagctctgattatattattcccctagtcaaaaaccatagtcggctttccactgcctgttgcagtggtgttcaaagtccatttgttcatttgtctgtttgttctttggtttcaaatcagcagcaccttttttttcaagtaaaaaaaattaggtagttaagatcccaaaatgtaaagcagataaaagtagacatgccttaaaaaatatgtagacacactgtagttgaagtgagaagttgggggtgagaaagtagggaagctctgggccccttgctcctggcagaacccttggtcctcagggaacacagtgtgaagaccactggcctgctcataagtttaaaatgcctttgcttgccattcaagactgcactaacctggccctaaactgcctctcccatgagacttccaattgtccttaaaggaaccctttgcttcagccgttcgttctgctctctgtcttccccacacaactgggacattctttacctttgcactgctaagcccccaagcctgaaatgtccactactgttcttggttcctgtctgacttgcattcaccctttgaaaaccagctctagttctacttactttaagaaatatttgccggcttccttgttccgcagggactcacttactggagctgtaatgactttatcttccaaaagaacaaaagagaagcagcccaggaaataaattcctatcaactctgtttttatgtgctccttctggctagagaagccttatgatgttaccactctctgaagtccctcttctgtaaaattgggacaataatagtagtcatctcagggattatgcaaggattaagttatatcaagctcctagcccagggtttagcactagtaaatagtataacttactagttatactagcaagtgtaactggtaagtagtataactagcaagttatactactaactagtatagtaagtagtatagtaagtagtataactcgcgagttatactactaactagtatagtgactggcttcttttttgtgactggcttctttcatttatcataatgtcctccaggttgatccatgttgtagcatgtgacaggatttcttccttttctatgactgaataatattccactgtatggatatatcatactttggttatccatccatctgttgatggacacttgggttgcttccaccttttgactattgtgaatatgctgctataaacattggtgtacaagtatctctttgagatactgtttttgactcttttgaatatatacccagatgtaaaattgctgtatcatattgtagttattgttttgtttgcttgatgaatctccatccagtttctcatagtggctgcaccattttacatccctaccagcaatgcacaagggttccaatttctcacatccttgcaaacccttgttattctctgttttcttgttgataatggccatcctattgggtgtaaggtgatatctcattgtggttatgatgtgtatttccctaatgattattgatgtagagcatcttctttgtgcttattagtcatttgtatatctctttggagaaatgcccattcaaatccttccaccatttttaaatcaggttatttgttgttgttgttgttgctgttgctgttgatttgtagaagttctttatatattctggatattaatcccttaacagatatgtggtttgcaaatatattctctcattcaatgggttgctctttcactcttgattgtttcctttgccacacagaagtttttaagttcaatgtagtcatatttgtctatttttgctctttagtgttattttaatgtgtctatatcctgtcttctcactgaaactcaaagctttccaaaggtacagtgcatgattcctcttgtgttgtctgttgtgtcatgctctgtgccacgcacatagtaggtgctcacgaatatgtaccaaccaattaattgaatctccatatgcacattaacctattatcagccatgagtgccttagcaaaattatttttttagttaactggaagcttagaggatagcatctatgattgggccaaaggagagacataggttggaggagtgaatagaaaacatggggccttctcaggaagaggagactctatggcagcaggtggggacattgtgcctgacatacggaaaggtccccataaatgttagctggtatcattatttgtgcactagctgtctgagacagggagaggcaatgctgggataactgaatggaaatatgagaaattcaaaagagaaactttttgtcagcttgccttcttaaaagtatgtgtgtgtgtgtgtgtgtgtacatatatatgtgcacacgtgctcaagtgccaagatccaaatttgttttgcgaccaggaagataattcactgtttgcgttatttccaagagtaaccattaatgcaggtagagaggaggaccacaaatgtgattactattcagtagactctttttggatgatgtccatgcattacttatctcacatatactacatcagtgctaaagaagaaaggaaggaaagaaggaaggaaggaagggagagagggagggagggagggaggggagaagaagagaggagaagagaggagaggagaggagaggaggcaaaagaagaaaggaataattaggagttgattaaagcacctgccctaggactcttggagataaataggattttctgacctgttactttattttaaaattaatgttgcctttggggctctcagtgctaaatagtgaaaactcaacaaagatagtagtccctgctttgggctggaaaacatcacaagggaaattagaaaacaccttgagatgaatgaaaatgaaaatacaacatatcaaaatttatggaacacggtgaaagcagtgctaaaagtgatattcatggctataaatgtttacattgagaaagaagttcttaaatcaacaacctaacttcacaccttaaggaattaaaaaataacaagctaaacccaaagctagcagaggaaagagaccaataaagattggaacagagataaataaaaatagtgaatagaaaataaaataaataaaatagaataaaatagagaacagcaatgaatccaagagatgtctctttgaaaagatcaacaaaattgacagagtttatagctagatcgactaagcaaaaaaaagagaagcctcaagtaactaaaatcagaaatgaaagcacagacattaccaaaaatgttaaaggaataaaaagattataagggagtacaatgaagaatggcatgttaacaaatgtggtaacctagataaaatggacaaatttgtagaaacatacagcctaccaatattgaattatgaagaaatagacaatgccaatacacctataactagtaaggtgatgaaatcagtaatcaaaataatttaaaggaagaaaagccaagatccaatgggttcacctctaatttccacaaaacatttaagagtaattaacatcaatttgtttcaaactcttaaaaaattaaagaaaagagaatatttcctaacttactctatgaagccagcattaccctgatatcaagctagaaagagacactgcaagagaactacagaccaatataccttatgaatattgatgcaaatatcctcagcaaaatactagcaaatagaattcaatagcatattaaaagggttatatgccttgagtaagtgggatttattcctcaaatgcattgatgggtcaacattaaaaaaatcaatcaatattatacaccacattaacagcatgaaggggaaaaccacatgaccatctcaagttacacagaaagagcattttacaaaattcaacacctttttgtgatttttaaaaagaactcaataaactaaaaatagaagaaaactacctcaacataataaggccatatatgaaaaacctacagctaacatcatgcttaatggtaaaagactgaaagcttttactcaatgatcagaacaagacaaggatgtcagctttttggcacctctattgaacatagtattagaatgcctagacagacagcaattaggcaagaaaaataaataaaaagaatctaaattgaaaaagaaaaagtaacattatctctctttacagacaatatgatcttctatatggaaaatgctgaagattttattttaaaaactattagaactaataaatcaatttgggaaattgtcaggctgtaaaatcaacatacaataatcagttgtagttctatacaccgacaacaagcaatctgaaaaggaaatgaagaaaacgatttcatttaaaatagtgtcaaaaagaataaaatacttaggaataaacttaaccaaggagacaaataaatgtgtactgaaaagtataaaacattgctgaaagagattaaagacacaaataaatggaaatatggaaatacatctcatgctcttagattgaaagacttaacatatttatgatgtcactacccaaagtgatctacagattcagtgcaatccttatcaaaaccccagtgacttttgttgcagaaataggaaaatccatcctaaaatttatatggaatctcaagggaccccagatgagtgaaacaatcatgaaacagagcaaagttggagaactcacacttcttaatttcaaaacatactacgaagcttacagtaatcaaaatattgtggcactgtcataatgacagacacatataccaatggagtagaagagagcccagaaataaaccctcattagatggtacctttttgtacccttttgacaagggcacaaagtccattcaatagggaaagagcaatctttccaacaaatggtggctgggaaaactggatatccacatgcaaaggaatgatgttgggcctttaccttacaccatatacataaattaacttaaaacagataaaacacctaaccataataactaaaactataaaactcttagaagaaaacataggggaaaatcttcgtgacattggatttggcaatgatttattgtatatgacatcaaaagcataggcaacaaaaaaatggataagttggatgtcattaaaattaaaaacctttatgtatcaaaagacaatatcagagtgaaaaggcatcctacagaatgagagaaagtatttgcaaatcctatatctggtaagggattgatatccagaattgtaaactcaacaacaaccacaaaattcgattataaaattatgcaaaggccaggcaaagtggttcttgcctgtaatcccagcactttgtgaggccaaagcaggaagacggcttgagcccagtagtttgagaccagcctgggcaacatggcaaaacaccatctttacaaaaaaaaaaaaaaaaattagcctggcatgtctcctgtagtcccagctactcaggaaactgaggtggcagaattgattgagcctaggaggttgaggctgcagtgacctgtggttgtgccactgcaatccagcttgggtgacagagtgagaccctgcctccaaaaaaaaaaaaagaaagaaagaaaagaaaaaggggggggggcaaatgatttgaatatacatttctccaaagaagatatacaaatgacctatatacacatgaaaaggtgcttgacatcactagtcattggagaaaggcaaatcaaaacaacaaatgagataccaccttacaccagtaggatggccattttacaaaccacacacacacacaaacacacaaaaaataacaagtgttagccaggatgtggagaaataggaactcatgtgcattgctggtgggaatgtaaaatggtacagctgctatggaaaatggtatgataattcctttaaaaattaaaaatagaattaccatatgatctagcagttctacttctgggtatatacccaaagaaattgaaagcagggacttcagtagatatttacacatccatgttccttgcagcattattcacaatagctaaaagttagaagcatcccaagtgtgcaccaacagatgaataaagaaaatgtatatgttactcatcctttgaaaggatggaaattctgacatattctacaggaatggatgaactttgaagacattatgctacgtgtaataagccagacaccaaaggacaaatattgtatgattccatttgtataaagtacttagagtactcaaatccatacaatcagaaagtagaatggtggtttccaggagctgagaggaggggagaatggggaattgttggttattgggtatacagtttcagttggggaagatgaaacatttctggagagagtgatgatgattgcacaacaatgtgaatgtaggcctgagggaggattaagatggcagataggaggcaggactagcttgcagctcccactcagacagacagagcagtgtatagagactctcatcatgaacttttgctccaagaactaccacaggaacataccagggaagccgagagaatccacagaccctttgaaggaactggatcaccactgcaggttccctgagatgtcaaaaacctgtgtctgtttgctttctcagccagtggggaggcttgtggtctggggtaagttctcagccctgatcattggctgcctagaaatagacttggtgctgttgtgggggtatggtggaagtgagaccggcctttaggactgtgggctctgtgggaaaggggtgaggcctgtgactgccagctttccaccacttccctggtgacctgtgtgacttatcagaggcagtcataatccccctgggtatataactccactggactgggaacaacacccccatcccccacagcagccacagcaaacactgcataaggagaggcggagctcagacatgcttatccctatccccaactagtggtctttctctacctgcccccgggaagacaaatgtcataatctcttgggagctctattgcccttcctacctcctgagaaacctgaatacttaatcaggtgtctttgcatcctccttgtagggccacagttgatgcactcctgaaagggttacctcctggctgggggccaaccaacacaaaaccagcccactacacaaaaacacaaccaaagaccctcacagagtccattttactcccctgctacctccaccagagcagctgctggtatgcaggactgcaagacctgaagacagattacatcacaggactctttgcagaaactccccagtaccagtctggagcccaatagctccactgggtggctagacccagaagagcaaaaacaaatcactacagcttagctctcaggaagcctctttcctagaggaaggggaaaataacacattaagggagcacccatgagacaaaacaatctgaacagcagccattgaaacctagatattccttctgacatgagaaggaaccagaaaaacaattctggtaatacgacaaaacaaggttctttaacaccccccaaagatcataccagctcaccagcaatggatccaaaccaagatgaaatctctgcagtgccagaaaaagaattcagaaggtcaattactaagctaatcaaggaggcactagagaaaggtaaagtccaacttaaagaaatcagaaacatgatataggatatgaacggaaaattcttcagtgaagtagatagcatgaataaaaaaaatcacaaccgcaggaaatcaaggacacacttagagaaatgcaaaatgcactggaaagtctcagtaatagaatcaaacaagcagaagagagaacttcagatctcgaagacaaagctttcaaattaacccaatccatcaaagaaaaagaaaaaagaatttttaaaaatgaacaaagcctccaagaagtttgagactatgttaaacatccaaagctaagaataattggtgctcccgaggaagaagagaaatctaaaagtttggaaaacatatttgagggaacaattgaggaaaacttccccagtcttgctagagatctagacatccaaatacaagaagctcaaagaacacctgggaaattcatcacaaaaagatcaccacctaggcacatagccatcaggttatctaaagtcaagacaaagaaaagaatcttcagagctgtgaggcaaaagcatcgggtaacttacaaaggaaaacctatcagattaacagcagatttctcagcagaaaccctataagctagaagggtttggcgacatatttttagcctccttcaacaaaacaattatcagccaagaattttgtatccagagcaactaagcttcataaatgaaggaaagacacagtcttttccagacaaacaaatgctaagagaattcgccactactaagccagcactaaaagaaatgctgaaacgatctctaaatctttaaacaaatcctcaaaatacaacaaaatagaacctccttaaagcataaatctcacaggacctatgtaacaataataccatgaaaaaaaacaaaaacaagttgttcaggcaacaaataacacaatgaatagaataatatcacacatctcaatactaacattgaaaatagatgacctgaatgctccacttgaaagatacagaatggcagaatagatatgaattcaacaaccaagtttctgctgtcttcaggagactcacctaacacataaggattcacataaacttaaggtaaaggggtagaaaaagatattccatgcaaacggacaccagaagtgagcaggagtagctattctttttatatatatatatatactttaagttctggggtacatgtgcacaatgtgcaggtttgttacataggtatacatgtgctgtgttggtttactgcacccatcaactcagcatttacattaggtatttctcctaatgctatccctcccccaggcccccactcactgacaggccccagtgtgtgatgttcccctctctgtgtccatgtgttctcattgttcaactcccacttatgagtgagaacacacggtgtttggttttctcatcttgtgttacattgctgagaatgttggtttccagtttcatccatgtccctgcaaaggacatgaactcatccttttttatggctgcatagtattccatggtgtatatgtaccacattttctttatccagtctctcattgatgggcatttgagttggttccaagactttgctgttgtgaacagtgctgcaataaacatacatgtgcatgtgtctttatagcagcatgatttataatcctttgggtatatacccagtaatgggattgctgggccaaatgctatttctagttctagatccttgaggaatctccatactgtcttccacagtggttgaactaatttacactcccaccaacagtgtaaaagtgttcctatttctccacatcctctccagcacctgttgtttcctgactttttaatgattgccattctaacaggcatgagatagtatctcattgtggttttgatctgcatttctctaatgaccagtgatgatgagcattttttcataagtttgttagctgcataaatgtcttcttttgagaagggtctgttcatatccttcacccatttttttgatggggttgtttgtttttttcttgtaaatgtgtttaaattctttgtagattctggatattagccctttgtcagatggatagattgtaaaaattttctcccaatctgtaggttgcctgttcactctgattatagtttcttttgctgtgcagaaactctttagtttaattagatcccacttgtctattttggcttttgttgctgttgctttttgtgttttactcatgaagtctttgcccatgcctatgtcctgaatggtattgcctaggttttcttctagggtttttatggtgttaggtcttacatttaagtctttaatccatcttgagttagtttttgtatatgatgtaaggaagggatccagtttcagctttctgcatatggctagccagttttcccagcaccatttattaaataggaaatcatttccccattgcttgtttttgtcaggtttgtcaaagatcagatggttgtagatgtgtggtgttatttctgaggcctctgttctgttccatttgtctatatctctgtgttggtacaggaccatgctgttttggttactgtagccttgtagtatagtttgaagtaaggtagagtgatgcctccagctttgttctttttgcttaggattgtcttggctatgtgggctctttttgtgttccatatgaaatttaaagtagttctttccaattctgtgaagaaagtcagtggtggcttgatagggatagcattgaatctataaattactttgggcagtttggccattttcacaattcttatatcagacaaaacaaactttaaagcaaagcagttaaaaaaggcaaggagggacattatataataataaaaggactagtccaacagaaaaaatcacaattctaaatatatatgcacctaaaactggagctcccaaatttattaaacaactactagacttaaaaattagatagacagcaacaaaataattgtgggggactttaatactccactgatggcactagataggtcatcaaaacagaaagtcaacaaagaaacaatgaacctaaactgtaccctacaacaaatggacttaacagatatttacagaacattctacccaacaacttcagaatatacattctattcattagcacatggaacattctccaagacagaccatatgataggccacaaaacgtgtatcagtaaatttaagaaaatcgaaattatatcaagtactctcttaaaccatagtggaataaagttggaaatcaactccaaaaggaaccctcaaaaccatgcaaatacatggaaattaaataatgtagtcctgaatgatccttgggtaaacaatgaaattcatatggaaattaaaataattatttgaactgaacaataataatgacacaacctatgaaaacctctggaatacagcaaaaagcagtgctaagaagaaagttagtagcattaaatgcctacatcaaaaagtctgaaagagcacaaatctaagatcacacctcacagaactagagaaacaagaacaacccaaacctaaacccagcagaagcaaagaaataacgaagatcagagcagaactaaatgaaattgaaacaaaaaaatacaaaagataaatgaaacaaaaagctggttatttgaaaagataaataaaattgatagaccattagcaagattaaccaagaaaataagagagaagatccaaataaacacaattagaaacaaaacgggagatattacaaccaacaccacagaaataccaaagatcattcaaggctactatgagcacctataagtgcataaactagaaaacctagaggaaatggataaattcctggaaatatacaaccctcctagattaaaccaggaagatacagaatctccaaacagatcaataacaagcagcgagattcaaatggtaatttaaaaattgccaacaacaaaaaatgtccaggacccaacggattcacaggtgaattctatcagacattcaaagaagaattggtaccaatcctattcatactattccacaagatagaaaaagagggaatcctccctaaatcattttataaagccagactaataccttaataccaaaaccaggaaaggatataacaaaaaaaaaaaaaagaaaactacagaccaatatcccgaaagtaggacatagatgcaaaagtcctcaacaaaatactagcaaaccaaatccaacagcatatcaaaaagataatccaccatgatcaagtgagtttcatatgagggatgcacagatagtttaatatatttaactcaataaatgtgatacaccacataaacagaatgtaaaacaaaaaatcacatgatcatctcaatagatgcagaaaaagcatttgacaaaatccagcattcctttatgattaaaaccctcagcaaatttgcatagaagggacataccttaaggtaataaaagccatctacaacaaacacatagccaatattatactgaatggggaaaagctgaaacattccccctgataactggaacaagataaggctgcccactttcaccacttctattcaacatagtactggaagtcctagccagagcaatcagacaagagaaagaaataaagggcatccaaattggtaaagaggaagtcaagctgtccctatttgctgatgatatgattgtatacctagaaaactctgaagactcttccaaaaagctcctagaactgggaaatgaattcggcaaagttttaggatacaaaattaatgtacacaaatcagtatctctgctatacaccaacagtgaccaagctgagatcaaataaagaactcaacccccttcccaatagctgtaaaaataaataaataaaatatttaggaatatacctaaccaaggaagtgaaagacctctacaaagaaaactacaaaacactgctgaaagaaatcatgggcaacacaaacaaatggaaacacttctcatgctcatggataggtagagtcagtattgtgaaaatgaccatactgccaaaagcagtggacaaattcagtgcaattcccatcaaattaccagcatcattcttcacagaactagaaaaaatatcctaaaattaatatggaagcaaaaaagagcccacatagccaaagcaagactaagaaaacagaacaaatctggaggcatcacattacctgacttcaaactatactacacagccatagtcatcaaaacagtatcgtagtggtataaaaataggcacataggtgaatgaaacagaatagagaacccagaaataaagccaaacacttagagccaacttatctttgacaaagcaaacaaaaccataaagtgaggaaaggacactctatgtacaaaaaatggtgttgggataattggcaagccacatgtagaagaatgaaactggattctcatctcacgccttgtacaaaaattaactaaagatggatcaaagacttaaatctaagacctgaaaccatgaagattctagaagattacatttaaaaaaaaaaaactcttctagacattggcttaggcaaagacttcatgaccaagaaccgaaaagcaaatgcaacaaaaacaaagataaatagatgggacttaactcaactaaaaagcttctgcacagcaaaataaataatcagcagagttaacagacaacccacagagtgggagaaaatcttcacaatctatacatctgacaaaggactaatgtccagagtctacaaagaactcaaacaaatcagcgagaaaaaaacaaacaatcccatcaaaaagtgggctaaggacacgaatagacgattctcaaaagaagatacacaaatggccaacaagcatatggaaaaatgctcaacatcactaattatcagggaaatataaatcaaaaccacaatgcaataccacctcactcctgcaagaatggccataataaaaaataaagaaataatagatgctggtgtggatgcagtgaaaagagaacacttttacactgttggtgggaatgtgaactagtacaaccactgtggaaaacagtgtgaagattccttaaagaagtaaaagtacatctaccatttgatccagcaatcccactactaggtatctatccagaggaaaagaagtcactatatgaaaaagatactttcatacacatgtttatagcagcacaatttgcaattgcatacatatggaagcagccgaaatgcccatcaatcaatgagtggataaagaaaatgtgatatgtgtatatatacatatatatgtatataatatatatgtgtgtgtgtgtatatatatatacatatatatgtgtgtatatatatatacacacaccatggaatactactcagccataaaaaggaatgaaataatggcattcacagcaacctggatggaactggagactattattctaagtgaagtaactcaggagtggaaaaccaaacatcgtatgttcttactcatatgtgggaactaagctatgaggacacaaaggcataagatacatttggctttggggacttgggggaaagggtgggagggggtgagggataaaagactagtcactgggtagagtgtacactgctcgggtgatgggtgcacaaaaatatcggaaatcaccactaaagaatttattcaggtaaacaaaaaccacctgttccccaaaaacgtattgaaattaaatttaaaaaagtgaatgtatttattgccacagatttgtacaagcaaaaatgattaaaatggtaaatttattttatgtatattttaccacaatgaaaaaagaatttgttagaaatccaaattgaaattttagtataagggaaaaataataatttaacaaaaaaaaagcaattaaaaattgaagcctgttttgtggtagaactaaaccaatatggaagtcagctagatacatctgttaataaaagttgggttgataaggtaaataaaaagcaataataggagcaaacacttagtaagcacttgctgtgttccaagtactttacaaacattatttaattttcacaaccacctgtggggaagctactgttattatccccaatatacagatgaggaaagtgaggctctctgttgagaccaggaagttcactgtgttgcctctaaaacacagtctcagctgggcacagtggctcatgcctataatttaagcactttgggaggctgaggccagacgattgcttcaggccacaagttcaagaccagcctggaaaaaatagggagaccctgtctctacaatttaaaaaaaaaaaattagctgtgccacagtggtgcactcctgtaatcccagctatttgagaggctgaagcaagtggattgcttgagcccaggagatgcaggctgctgtgggctgtggtcatgccactgcactccagcctggtaacagagcaagaccctgtctcaaaaataaataaaacaataaagaaataaagaaataacggcctctacctttgagcagatcacaatcaacaaagagaagcctataggcaatgataaaactctacaacatcatacatattgcaaggaatgtaggtatgaaatgctacaatagaacagacgaagatgcaatttcagttgaccctggaaccatatgggagttagggttgccaagcccccacacagtaaaaatcagtatataacttttcagtcccccaaaacttaactactaatagcccgccattgaccagaagcagtactgagaacataaacagtcaatcaacgtgtattttgtatgttatatgcattatatactgtattctcacaataaagtacaataaagtatgccaggaaaaatacaatattatcaagaaagtcatgaggaagagaaaatacttttactataccatactgcatttatcaataccgtaagcttgcatcatctgtttaaaagatgaatcgtctgtctgaaatagtgggccactgcagctgcagacctcaatctacagtacatatcaagcaatcaactttttcttgtagtgtcttgacttttctctgcttcttgggagcacttccagcatgactaatggcacttcgtgtggatctcctggtgttattcaaggtttacagcattgcactatatgtgatgaaaaacatgtaagaacaacaaggatcactttttactgtgatctgcaattaactggagagaggatctgcttacttgaagatgattagcatcacatggcattttaaggaacactcataatacttgagctcactacaagaacaacaggaggttggctacaaaatattacagcagtacagtgtgtactacaattaattttatgcagtcatgatttaatactgcatcattacatctgcttacatttctctcaactgtgaatggtgccatgtatggtctgtttgtgcataagttttgataaattttaactttttataatagatttgtgtatttttatgggagtaaatgataaaatatatgagtatctacatatattttatgcattcataacatatctttttggtttttttttaaatatttctaggcaacatggttcatctccgagttttcttgcccgtgttcactgaggagaaattttgtgtagaagagtggtagagttgatgtatgagaattattgggaatgtgtagtgagaaggaaggacaggactgaaaagatctagaaagcttaagagaagggctgcttagttcaactcaacaattgttaaagatccgatttccatatttgccaccagaattttcacatgacactccctttgagagactacattaattgtggagtttatttggctttaagattccaagaagattaaagccaaagattaaactactctatttatgttggccaaatagatgggtgggtggatggatgaagggatgttgaatgtatggatcatagatgaatgaatggatagttgaagggatgttggatggatggatggagctagatggaaggatggctagactattgctagactgagaaaaaggaaaaaaatctgagcttcatctgcttgtttcctgattgtttttgaagttcaggtagacctgcctcaagacatcatgaaatacttcctggttattttccacttctttaattacattttaaatgtacctaacagtgatacaaatgctgcatttagcttagttttaatacatttgaatgatgttaattctcactgtgaaagtttaagctacattacaagtcggtttgtagtcagctgtactagtaactgtcttagaatttggcaactggcgaacaactaactccacagaacccacctttacccttgtcccaaccaaattgcagcatgaactagtgatgtggtcaaagccagttgtttgaaatgactgattcagtggaaacaagacatttcactcattagcatatatatgcaaaacatataaattgattacctactgcaagacatttgtctcacatagctcctatgtttggggaggtcacagtctagtgaaatagatatgtggaacaaggaactagaatacagtaagtgaggactagattggaagtaggtagagagagctaggcaagtctagagcaaggggtgatgagctagagagggtcagagaaggctttgtatgggaaagaggtactgggaatccctggaaaccaaccctaaaagattaggcatcctcctgtagagaaaaggaaacaaatgaagggattctttgagcagaaaacagaagcaacatatattttaacactttctggttgatgctggcccatcatcatgcttagtgactgtagtgactaaatgtctatggttaaatcagttctgatttccagacatttggtgaacaaaatcagaggtgggagcagcttttcctttattgttatttgtttgattgtgtacttgttgtttctttttgcctccaatacaattaatgtcttcatctttctcagcctactttgacttttcagcagcggacagaacattgtcttatttaggggttactatcgcaacctcattttcaacttttgccctctcttcttctcaggtgcaagagaacttaaccatttagggacccatggatggaattctgtgggtctatgaactgggatttgtatttttactaatatctaactgaaagttagcttttccctcgattaccaatgtaggcaacaaacaacagtattagcaagagttgtgattttatcaccaatagaaatcatattttcctgtaacattacggctgtggctgatatcttgaaatatcatttgtgtgcatcactatttcaaaattacagtagttatgagacccactactgtaacttgttaatgaagcacataaatgactacatcacaaatctttaaaaggtatttcaatattgttcatttccttagtaatcttatatatttaattttatacatttaaagacactgttttgagagggatttactggcttcatcagggggccatagcacaaaaacggttaagaggctctacactgcatttcctataattgcttgttctagaaagtaaggaataacacatttctttttggccaccatgttggcagctttcattcagaaactttcccaagcttgcaaacatttagatcaatgctcttgaagaccattacatcttggttgcatttgtgtaactatagttttttaaaaaaaggaacagtatgtgcaaactctggttttcagccaagccttattctttagggcaccagacctctgggtgtaagataatccatgtattgctctacttgcagctactgttcctgttatttgcagggacagccagaaattgcgatttgggtagctcaccatattgcatttaaccattcttcttcccaggatgacctgtgaactatgtacttgtttagatcaaataaagataatgaaaaacaaaacgaaaactgcccaatgctgagcacagacgaggcaggcacttgcagacccttattagaaaagaaagaggcatggaagacatgtaaatttcatctgatgggggcaattttgctccgtttccctttctcctgattactgaagtgaagggagaagggaggaagattggctcgattgtcaaggaaatgaggtagtttgggtcagctcacgggtaactcaggccctaatgaggtagggtcttaatgagccagatcttcctccttgtcctcttcttaaagggctcttcataggctcattgtcagtttgtctcccatacttatgtacttgtcttctttcccctcattactaacccgcaggaaggtacacttgggcatatatgtcagtgtatgactcacacagaggatttgagatgtgatatacatacacagtttcacttgatttattatcagcagatttagatatgctggccctgaaacatcccaaatctatagagtgaaagagagcctggtagagctcacacatttacaccctccctctctctgtacacacaggggcaacacacacacacacattctttatggccatagccctctacacatctgtgtcacaaacagctgtgacgaaccaaatcttgccacccatcacctacttctgtgagaggtgttacttgtccaagcactcatgtctgtgaggagcatgcatttccaaatgtgctgtgcccctcctctccctcctcctcctccatctctacagatccaaacacacacgcaggtattcataatgcacaggcctaaatgtcgaggtcaggtatcctttgcctcacaggcactgtacagatctgaaagatcccacattgactgcactcaccttgctgtcgctgctgactcaatgaaatggaacttgccctaatttgtttttaattttggtagacatctgagctggcaaaggaagaactcaggtggacccccttgataagacttttctcaacatttgggaatgcagctcccttggctaagctagccagctatatagttacaggaaaggctggggtgtctgctacccacgctttttaaaatgattccccaacaccaaattagccaactgcgcttaagtgattcctatttgactaattgcttttaaggagtctgttaaaacccctcacttactccagcccacactccgtcagacattgcaaaacagcactatggttggggcagtggctgggaagcagctatggttgctaggatggagacagcctggtgtgatggcttgggtgggcccatgttgtttttattattattattttgcaattatgtgagaggagcattatctcatatacttttaaaaaaagaatcccactgtctcatcccttaggtcattcctgtgccatcactccagcaaaactgtgtactctttatttcagtttcaaactcttgtctcccctctccctgccatacacacaaacacacaagtgtgtgtgcacaattctaccatacagttcttcttctttattttatttctgcattttgttttccatgaggaaggcagctagagagtgaaactgaaggatggcttattttctgggtgatagtcacagtaacctacttgaagggttaaactatgcccaaagggagagaagctccctcagaggggttgggggtcggggaaagagagaggaaaaaaaaacagtgagagatagagagacagagaaactgaaaaggaaaaatcccagaggagatttttgaaaagatgatcctgagagcaaatggaggtcaccttccataagcaagactatggcccactgcttcaatgaccacattgtcattgcttcttcactcatccccttctgacagtgtataaaatccagcttttacataagcttctttggctggttttttagtcaacctctttattacacagtgatgcttctgtttcagtccttcagtaattccccaggtccgaaccagtatattacaaagggccaaaggatgggcttgctgtcaccagttatctggtcttttccccatgacaacatctgcatcctgtctgaggtgctgcacccccttgaaactgaccttgacagatgtgttaggacttgtagtgtaggggaatgaccttcagactaacagataagagacctaagttcaattccacctctgctgataactatatgaccttaggcaagtctactcttctctgggccttactttctcatcttttaatagaaatggtggctgggcgcagtggctcatgcctgtaatcccagcactttggaaggctaaattgggtagaaggcttgagctcaggagttcaagaccagcctaggcagctagagatggagaaatcccatctctaccaaaaatacaaaaattaactaggcatcatggtgtccaactgttgtcccagctacttcaggggctgaggtggaaggatggctggaatccagaaagtcaaggctgcagtgagccgagattgcaccactgtactccagcctaggtgacagagtgagaccctgtctcaaaaaaaaaaaaaaaaaaaaaaaaaaaaagaaagaaagaaagaaagaaaggaagaaagaaagaaagaaagaaaaaaagaaacggtaatatctgccttgccaacctcattgctttgttgtgaggctcaactaagatgtcagaaaaccatcctgaaacacaaacagtgctgtgataatatatgtacttgtggtcaacaaaagtcaaggattctgcctcttgtttcaattctgcactctgcggggacttacccaaatctctaagcctcagtttgttcaccattaaatagccattacaatgcccagagggagttgtaagcatttggctggatttttccaaaccacctgttgttctttactgtgggtagctgatgccatgctggggactgaatggtgcctggcatgagagcagggtggaagtggtgtggtgtgccagcaggcagaggctgtggtcacggctgtgaaacattattagctggatgtttccaggttttcctagagagagaaagagaatagaaagaaaattctttaaaaatagaactttaagtgctgtgcaactacatgatattatgttttagtccctctcatttattattcttaactctgtgttggcaccatgttaagttccgtacataccgtatgtcattccatctttgcttcagcccttgagggaagtattaaatagatgagaaaattgaagtttggagagaaagtttaagtaggcttctcaagattagcttgtttagaattggcaaagtcttactccaaagtctaagatcatcttgagagatggataacactagccccaatttacaggtcaggagactgaaacagagaggtaaataactttcacaaagctaaacaagctaaacggccagtcaatggaagagactgatgccaaagcccattcttgttttccctacaatgtaaaatgtggaccttgggctcccagtgtattgctaaatccatcagttcatcagtctctaggcagccatttcctgaaaatgtactgcagggggcttgttgaacacagaccacagtccaattgagacactaggaattacatgaggctaagctcaactgtccaaaatagcagctgagtctattaagtaggtagataggcttgtggccccaacaacagctgtttcctcacacaagcccaaagcacaccattatgtgagaaatggtctaaatgtgttgtaggccttttatgctttgtattagtccattctcgtgctgctatgaagaaatatctgagactgggtaatttattttaaaaaagacgtttaattgactcacagttccacgtggctgggaaggcctcaagaaacttacaatcatggtggaaggcacctcttcacagtgcagcaggagagagaataagagttggacgaagggggaacccccttataaaaccatcagatcttgtgagaactcactctcacgagaacagcataggggaaactgccccccatgatttaattatctccacctggtcctgctcttgacatgtggagattattatatcaaggtgagatttgggtgggcacacagagccaaaccatattagcttattaccaatttctttacagaaatcttgtccaatttatagtaaccacgcatgagagtgcccatttgagactccttgccatcatttagtcccccgattaaaaaacctcttatttgatgggtagaatttatatctgactgttgagtcatttttatgtgttttatcactaggtaaaagttgaatggtttttacatactcattagcaatttacaattcctcctttagatattgtttgaatcttttgcccatttaaccattagagtcttaggttttgtttgtttgtttgtttttgagccagagtctcgctctgtcacccaggcaggagtgcagtggcatgatctctcctcattgcaacctctgcctccgaggttcaagtgattctcccgtcccagcctcccgagcagtcgggattacaggcttgcaccaccatgcccggctagcttttgtatttttaatagggacagagtttcaccatgttggccaagctgatctcaaactgctgacctcaagtgatctgctcacctcagcctctcaaagtgctgggattacagtcatgagccactgcacccagccaagtcttagtatttttcttaacaaatttataagctctttatatatgaaggccatcaaccctctctcatgttgtggtgactattttttaaagcttactgactccctacaaatagtttgaaattgagaggatttccttttgggatttgtttgggttggtgtgaatggcttttttagccttctcacattccttgttcattcaaaaagtggtctctccttggtattgtggctttaccactcaaagaaaagcaagtgtttcagttctgggcagaaatagcatgaatattctcttccatttaattatagagactcagcgtaaccctggcaagaaactaaatcgagcccatcaagtagcagacagtgaagcccaactgtattcctagtatagtgcctgttacatagtacatgctgatgaaaagtttgttgtaaaattaaagcatgcatgaatctctccccaagaaccatgtattatcagttatagcttcatgtctcatcacctcagttatgaggcaaactatcttcttttttctcttgaactcttcattttcaatatttaaaaaacctgattatatcaggaacagggtatctataggtattcatagacctttaacactaataatttccctttcatgaaggggctcataaggttccccaggtttcttgtgaatattatggagaggcttgcaacatagtgattacaatcccaggctttagtgacaaaaagatgagagttcaaatccaattctgcaatttactggctgtttggatgttgacaaattatttgacctccctatgcttcaacctttatatatgtgaaatgaagatgatagtagccccaaactcacagggtaggggtgattctgagggttaagtgaaataatgtatgcaaagcatcaggcatggaataaataagcactcatttaatggtagctacaattattatcaacaacaatgtattatatgttgggggcaggaagcaaggatcaggttagtatcagggactatagcataaagggcattgaatgtgaagtcccaacaaatagattcacgttcaaattctattatcaccctgtgactttggagaagttccttttcttttgtggacctggtactttgacagtaagtgtcctgccatcctctgctcacctgggctgggataccatccccacccttcttacagaagcaatggcttcagcccttgaatctaccttgcagtcaagcatgataaaatcccttctgaggttaagtataatgaggtgtatgggactccaggaagagtaggtactaaggtgggtgcagtttataaggaggtagacaggttttacccagtaaaagagcttttcacagtgtagtggttaaatgcatagtgtcagaagccacattgcccaggtcagaatcctgactctgtcatttactagctgtgttgaccttaggcaagtattttagcctctctgacacttagttttcttacctgtgacatgaggataataatagtatctacatcataggattgttatgaagattaaatctttaatgtttataatttgcttagatcagtatctgacatatgtaaagcacaatataagagttttaaataacaaaatagataaaaataagagctaattaagaattggagggagttctttgatgggtagtgagtttcctttcactctcaggacatcatcagaggctggaggtattaaatatattcaagtaccaagagaggattggacaagataaacttgatcatcacttcctgatcaaaagttctatgacttgctttccaaggtcaccatggcagacttagacccaacttaagccataacttttcagtagatatttttcctcctctgctgctgtcaccctcatttacacttatgttttcttggatgacattttaaaattgatcaatacaattcacaggtatgaagggcagcttaaacctgccacccttcccttgctcacaaagcagctattactttgaaagccagttttactttctgcctttttgtcagatcttagccaaatttgattgacaagaggcttttggtgaaactgtttcattcgtgtgctggatgtcacttgctgacttacagtctcctcatttgtgaggtccctgatgctattaaatgagaggaattatcatgtcataaaaagaatgccatcagctagtcagttttatatctgacctagctgtacttgcatctgccatttgactttagcctcttatttgggcagagaatagcatccattcatccaccctccaccacctgtcactctcactaaagaccagaagaagtctgcctccaggtgaggtttctcagtgatggactgatagaaagagtgctggagttactctaagctcagcagaccaggctaatgctttaatagaccatgtagacaaagggcagtgaaagaactagggcagaaatgattttttacttggagaatcagactagattgtagcccacacagatgcagcctcctgaatgattggaggagtttcagtattcccagccccgccctaggctgaaatccaaaccgggaaggcaaggcaaggtgtgagcacataggtgaaggaatttccctcaagcagaggcccaagctcagaaggggtcctgtgaggcacataattcctagggtcttggctgaggcaagtctgccaaccctgaaaagccaggggatttcctgcatgttagagaatggctgaggccctggagtattttaaccactctgggaaaagtagatggagcaaaaaaaaaaaaaaaaaaagaagaatcaaaaagaaagaaagaaaaaaaaatgtctccaagacaccatcagagaagtagaaggtggaggtttccctgaagaagaagactcaacctggttccagagagactgccactcagcaactgcaagtatggccttggaatcggagagacttgggttcatgtcctggcttagccaagttccaccgaatgagttacttaaactcaccaagcttcgatttccccttctctaaattacagatactaataaaagcccctgattcattgggttgttgtgacaattacattatacagaatgtaggtaaagcacttagcactcttggcaaaaactaagtgcccagtaaatattaactattttaatcattatcatcataatgcatcaattactggaaacagacaaatataactttaagaaaatatagatacattttatatacttttcaatgcatactatatttcctaataaaaccactatttaaaaaaggaaaaagaaaagcagtatgacagagtggttaagaatgtatgacaaatcatggttcacactcccagcttgaccacctatccctgtgagtgtctaggtaaatcacttggcctcttgaggctcataggaccaaccgtgcaggatattgtcagaattaaataaggaaacccccataaagtgtttagtatagtgcccttcacagaacaaactaagatttatttctagttattatcattatgggttttcctctgcaactctcagccctcttgtgttccacttgattctaccagtctttagcccattattacaagctgtaccagagggaagttcagagtaacactggcggtttcctgggtgggggtagtcgagattgaaactatcaggccctagggtataatccagtggtagtgaaatggggtaaagcattgttaggaacccagcctattaactaaaggcactgtggctttaaaaggtaattgttttccagtggcctcccagagctgagtcagttcctcagtggaccctgtatcacgatatagctcctttcttccagcccccatcacagcagccaattcaacacatacactcctggctgacgcatttgccactttcttcaaatatttgctaaaagcttcccaaagcaggaagccttgcggttgcagagcattctctgagagaaatgaagcaatggtttctatggcaacactttggcacttattagtgtttgcgtaggcactgaggcaaaagctggggtccagacaagcccttgctgggaagggatgaggagaagagagggcttgggatgcaaaattgctctcactttgccctcttggtagtccttagggacagtcctgggggagtgtttggggcacaatttggccatatagagacagtctgaactctcctggggcagagattgcctcactcagtaccacctgtctttgccaccaggtttagcttccccaaacactccttcactgtgccacccctctgcccaaaagctttgcttcttttccccagtatctatagatcaagtgcaaatcatggcatttgtggccttccacagactccttttttcagaagctgtagctgcctccctcactgtaccccctgtgccttctacttcagcaagatggttcaacctcatcctacctccactccctgttacactgcaggtgtttctacttcccacctctcttccataccattctccttgcttggacttcctgataccatcgcccatgtatccaggacttgcctttccttcaagacctgtcttaagcctcagtttcttcaataaactttattggaccaccccaactcagtggaattccattctctgaattgagattgtattactactcagatctgtcatgcatttgacacttaaacacacactgccttgtatgttgttttattactgcatatatatacttttttatatatgtgtgtctttattactgcatatatatttctttattactgcatatatatgtgtctctattcaacaaatagatgtctctgtctagacagtaagcttctccccaaaaggggacttttaaagtgtttttctgtttttccacagtgccctgctcataataagaaattaattagacattatatgcacagggtttaacccggtgcctggtatatagtaagtgctggagagatgtgtggtaccctcgaatagttcttgattgataccctgtacctccattgccacttccactcatgggctgcatatggtgtccctggacattcatttagccttagccttggagccttcatgagccattaggttggcaaaactcagtgagtgaccattggtcttatccacaccatctcctgctgcccacccactcaccactgcagccctcaggacaggctgtgtcatttttagagcccagtgaaaaacagaaatgtgaggcctcttgctgaaatagttaatttcaagacagtgagagtagagcattaaaccaaggatagggctcttcagagttggggccctgtaccacggcacaggctatgttgcacacccacaaggccagccctgctcgccatcctacttttcttgtgccgtgttccaagttcctggcacaagagacaggggaaatccacatgcggcaaccacatatcaaatggctctagactaactgaccaaaatccaatgatccaaaagtgaattcattgaatggccaagtgtccaaaaaacaaatttgtgatgtctgtcttttattttgccctgcccttgcctttgcccaggctctgcccatgcctctgcctgtgcctacatctacactttcatcttctcacttcccaggtcttagcaaattaaactataaaggcaaggctgcatctgttttatgtccctttcccctcatgttctgatttcttttgaatcagtcatgatttctttgggggctgaggtgagcagccacatgaccactccatacttcactcacgggacagccagacagtagagattagtaaacattcaagagttaaaagctgaaggccaggggtggtggctcacgcctgtaatcccagcacttttgtgaggctgaggagggagaatcacttgagcccaggagttcgagactagcctgggcaacatagcaacaccctgtctctacaaaaaaaaatgtaaaagattagccaggtgtgatggcacacacctgtagtccaagccattcaggcagctgaggcaggaggattgctagagcccaggagtttgaggctgcagtgagttatgattgtgccactacattccagcctgggtgatagaatgagaccctgtctcaaaaaaaaaaaaaaaaattaaaagctgtaagcagaggatgtcatagtcttaaaatcatacttttaccctgctcatggataatataaaactgtaggacagtctcactccgtttcttcaaacacagtaagcatcattttatagtctgtctctggtatgtccaacatctgaagtctttgagggtctgtttctgctgtttgctctttctttagactcctggtcatggtctcttatttccttgtgtgtctggttatcttcatgtgctagttgttgtatttgaaaaactatttgtagtagtgatttgaagcccagaataaagttatctttcttcagagagagaatttgtatttgctttagtgagaatcctgaggcattgctagtctggagtaaatttaagtttactaattaagttttcctagacagtataaatgcaatctgctgctccccaaggttcatatgtggtttacccttattctgcaggtataatcatttggagccctagttttctgtggggagcatttcctagcagacttctcaccttctattggatctggactatgatttctgtccctcttgacccacaaggttttcaatattaaagttgaaattttctggcatggaaaaatgcccttagagtgaaagcagctacatccatgcttactcatctctttaggttctcactatcacttcatttttgcctaacaatacttaaataccttgttagtagttctttattgattttaagaagatttttaaaaaacagattttctgatttccggtggcttcaaccattataagaaacccaaagtatgtcacatgcaattctctcatcatgctttgaagtaggcaggtagactgggaggctaaaactatacatattttgtagatgggaaaattccatgaagttacttgcccagagccagacagtgaattagtgacagatcttgaaagagaaatcaggccccacatgttaccatcacattctcaaatgatgaagaagtattatttcccctacttatgccaaatgctgggaggatggcctttggttgctcctacttttccttccatcttctgtcatcattttatagtctgtcttctcccaaggggaaaccttgctttgttcatttggtctttgtaggagacccctagaaaaagagttggcaacttttgcaaagcagtggtgtcaagattcctggtcttctcctttcctttattcccaagtaccctggtcactcctgggatgttgctttagaaacagggagagggatgtggcagtggggcctgatcaacagcaaacacaggtgccttcttggctatggtggtggcctaattaccatgaatgatcaacgaggtctcctctgccgtctgccattgtctcccatcttctagtagcagtccctcaggtgcagctttagagaagctacataccagcattctggaagtgcttttacgcatgagtgttaatttttccatctgtcctgtcatctgtgactaccagaagttgatcttggaatgtgtttaagcaggttagtggaataaaaactccaagaaaacctgacattttggaattgcccatctaagctggatcattgaaattgtgaaccagagccttttagggaaggggttggcataagaaactcagaaatggctgggagatgaaagtttcaggctatatgacctatgacatgaaagcttacagtggtatacacagcctctgcaagagaagcccaatggacagacatcccagttacagacctctccagaccttttctcctccccaaatgaaattgacttccatcttagagcttaggtactgttagctattcttcccaagtatccttgacagatgctacaggtataatcaggtacaggtgtctgtctggaaagatgccaataagggcaagcaattggaaaggtgcccaaaatgtatacaaaattaacttggatgtcaatttgaacgtgctaaggtggtttgacacaagtgaaaggcagaaccatgctactaacactttccactatgttatgggcagatattgccaggttgccagaattatgtcatatttttattttcaacagttatattttctggcattttgagcacagcatttctattgatatttgagagggattgtggataatttagcatatggttatgggtttctttttcatttaaataagagatttcactaagcttgctatctccctgtatgtgatgtgattgcactcactgtctgatgttctgatgtttttttccccaggataaggagaaggaagctaataggaaagtttataaaggaaggcaattaaaaagttggatttatgaaatagaagttggatctattctgttaagtaaaggatgcatgtcttgccaacagtcatgcctagtcatatacctccagcaatagaggctctgttgtcctgagcaacattattatcttcttctaggaagttatggtctcagaattctaggaaactgcttccatggctgatttcactccaccacacctgccgtttccatggaccatggcgaggctaagctgtgggtcagtcaataaccctcagctgcattgctgatgttggtctggggctccattggacagaaaatgtttgacactgatcacctctatttgaccctgcttctgagctattgtttctgccatttccccactaattccaggtaacctagccttctcatttactgatctaagtttcactctgtaatctcatctcttattgttaacaagagccacctggctatcctccttaactgggagcgagaggagagcctcgtctgctgctgggcagagaaacttgtatgggggctgaggctgggaaaggcaagtaaggtcattttctgagtgcttactatttgctgggcactgtgctgggtgctttacacatgttaactctactcatttgctgtcagcgaaaggaagggtagaaaaggctcaaccctaaaggatgagaggctgaatttgtgttgttgttgttgtttgtttgtttgtttacaatagatggaatggtattgtgtaagggagggcttactccacaaagattaaggagcctatggtcaaacaagagtatgacttaaaacaagtcattttcctttactgagtttcagtttacccccctgtaaaatggccacatagtctttgctcagcttaccatatatacttgttgtgaggatacaagtgatatagaatgcttagaaaagtataaaataaaatattgcataatgtcatgtgaggcaatatagaatagtagttaagaaccagactacagatggggtgtaggattgcaaatctcagcccagcaacttgctacctatgtaacctcggacaagtcacttaacctctatatgccttagtttcaacatctgtaatgtgaggatatgaatagtacctgttcatggggtttttgtaaggaaaaataagatagtatgtgcaaaacattcagaatagtactagcacatgataaatgctgcataagaactgtttattattacaaataatagataactatgaatattttaggcccctatctttcccacatgcactctctcagtgttgtaacccttaatgcaacagaacttggctaatgctgcaagtcccgttatattgtacatagctctctgcatgccagggcacataaccctgccgtagaacacacataggccatagcacttggctatataaggaggtgggagctcagtactcccagtggatgagagaaaggcctctgtaaaactggatggcctctgaggtaaatgccataaaggattcatttacataaattcagaatgcttcttaacttttcagaaacatgtttcctgcattaagtgagatatatctgtatatagaggaagctgcagagttatagcatccctctacaacatttattgagagacaaagaggactaatgcgtgaggatgtgtgagataaaaagaagactaagacatagtccccaaccttagagagttgatcatttagtaggggagataagacatatagtcaagctcaacatgttgtaagacagaaccgtgttatcagagtaaatgagaacatacatatatcctttataagctgggaagactatataaatgccaatggttttaggttttttttttttaaacaagccttaagaattgcaaagtgctgtaggagatagagaagaaaggaaccatttcttactgggggcatcatggaaagcactgaagcatgagtagtctttcaacaggtagaactgagggcaaagggcaccagcaaagccctgcagatgagaactcactcaggatatgaagggaccagtaagtagcttgtgtcggcttccgcatagaatacacacaggagtcttcctgaaggatgacaaagctggaaagtttggctggaactgggcttaaataccaggctacggagttgggcttatttaggaggccatggggaattttagagcaggggaattgcatcattcaaacttcccttttggaagtcactctgacagcaggaagtgccatctcctctggccgcctgaaggacttttctcctgcaatgctatctctttctcttctgcatcatcaatctttctccagagatatgcagtggcagcctgctgctttcaaaaaacaaacaaatgaaaatcttttttggctgcatactctctttctatttctctacagccctgatagcacactgtctagaaaaaaaagtctatactccttgtttccacttcctcgcttatcaatctcttctcaacttgctttagacaagcatctacccccaggtatatcattgtcaatatcctcatatttttgtgaaggtcactagtgacctccatggagtcacatccaacagtcctttttctgcaatactcttttctcttgattttccaaactcagtactcttccagctttcctcatctctctctagccattccttctcagtctcctttgttgactatttcttctctatgtcatctctaattgttggcacacccgacggctcagttctagatcctcaacttctctttatcagtactcttatttaaagtgattttatccagttccatactttaaaaaaagtctgcctgttgatgatgctcatattcatatcttcagctctcacctctccactgagcttcaaacttatatattctcctatctacctaacatctccacttaggggtctaatagcatctcaaattttatcatggccaaaaacaccctcttgatctgtgcacttaccacatctgcaccaaattatttctactgcaggcttccccttataagtaaatggtaccatttgtccaagaccataacctaagcctcattcttgatcctattttctcccacccaacacatcctcttcatctatctattaacaagttctattggctccccctcaaaaacgtataaaaatccatccatgttgtctatctccactgctcccacctggcccaagccaccaccatcttttgcctagaccactacaattgtctcttaactggtttgcacacttctactcttgctcttctatatttttactactaattatggggcctacagtgaattcttcacaaaaccttcaaagtgaggttttaaaaacataaatcagatcatgtcactcatctgcttgaaaccatccaatagcttcctgttgcaattaaaattcaaactccttccgatggtttacaagggccctgcgggatttggccactgcatgtctcttcagcctcatcttgtgccacactccctcttgctcactatgttttagtcttactgtctttctgttctgttaacaagccaattaaggcctctgcactgctcttttctcttcttggaatgttcttcccctagatctttacatgtgacaggcttcttcttgccctttaggtctcagcatagatgtcacttcacctcagaaagagttttcttcaccatgtaaagtagcctcccttccttgccatcacttcctaatacatcagcctgttttattattgttatagtatttatttatgtcaaatcatcttatttatgtgtttattacccaatccccacacacaactaggatgtaagcaccattagagcaggaaccttttctgtcctattcacccttgtatctcccatgcctggaacagtgcctggtatgtagtagacacacaataaatatatattgagtgaatgtggcataaattaattagcagcagagtggttactgcagtgatacaaacaacaatcaataaaggttttaattaaattggtggtagtagtaagtgagatgaaggaggaaaaatcagtattagactaatcccacccaaattgcatttaaaggcatttaatacagaaaatttatcctaagtcactatttctagtacagagtatcaaaactaggaccacaaatcaattaagcaataaataattatccattcattaaccaaaaaaagaaatgaaagaataagtcagtggaacttggtgtataggagtagaaagaagaatgatgattccatagtttcttgccattagaacaaaataggaaatttgagagaaaaactgctggtaggtgggagggaagaatgacaggtttggtatagaacatgctgatttttactcatcctctgaggcgtctgggagactgcctcagtgtgagtttagaattctacaggaaggactgaggagaagatagagattaggtacataatcagcatagccatgagagttcaaagcaataggagtgggattccttgaggaataaaaatcaactgaaggggataggaaatctttatttcaagggatctgtctatcacatttcttagctcccaggaagtataactagaaatgtggattataataatttccattttccccaggcacttccccacagttcactccctctcttgaataactctgtggatgttttttcccaggtagggggttcctggtatgggctgtgaggaagcaccgtgatcctttttgccatcagcccccatatttatgcctctcactactaacagggacagatatcaagataagcaatggagaatgcctctaaaagattttgtggtcttttgggggaaaaagcctagctataaagaaagttatcacttctattttgctttttccaatgcaaatacacagtctgatcccttaaataccagaagcgatgctgtcagcagcaacaacttaaaaaaagttcaccccgatatgtaaagctttttttgtaaatcagacttgctccctaatgctgtcagttgaagaactgcccttataatttttactcactgccaacctgtgccttgccaagatgaaggagctcatctgagttagtagtagaactgggttgagaccctcagacttctaggcccagcccttcacctcacgagcagctgttggcagcaatctcagattgttattctaccctctttctttgcttcatcttgaacccttggtgggagccaaaagcctatcagagactgattgttctgctgctgttggcagattggcaccagccagtttcaatgcttgtgcaaagagcatataataggtccctaatgagggcaagacaatgagtgtttggttttgattgcagggcttatttgtcgtgtgtctgtgtctatatctagtccctacaaagcaaacctgttggtgggacagggcaggcaggagaggaggaggctgtgaaatagagactcaaaggacaaagtggcaagtggtccaaggctctgcagtggttcatagctataggaaatggaacctagaacttagtcctgtgccttgggccttgggcttgagcagaagagagaggagtgggtttgggtggtcacagtgggctgttatattctgaacaagacagaacagtctgaatttgggttctggaaaaggaatcaactcctgttgggggaaaaaagtaagctctattggagcagtaactttgtttgtcttcttcacctctgtatccccagggtctagaaaaatgcctggccatagtacctctacaataaatatttgttgaatatgaatatgaatttttttctgaatagaaatctcgagtctttgagattttattgattaactcagcttgtctagcggaagcctttccctggctttcactggaagaatttaatttgtgtaacagtccaggcaataagccaaaaccccacagagattgctttttagaattgctcttgtgcccatttgctttattttcgctttcctctagacctggtcttccatattgaacatttcgagatgttttttctcctgagctaataatctccataagctcccatttttcttgccccatcactgggttgctgatacaatctgaacctctgataactgagatttccatttgcttgctgatctctccttagtacagtgggccttatgaacaacgtgtgttaccgtgtgtgtgtctgtgtgtgtgtgtgtgtgtgtgtaagcaatcagaactgcctggaaaaatgaaaataagtaaagagggcaatggaaggtgatgattcacacataagtgaaatgattagatacttctcagcctgtcactagagtcttatgaatactagacaggaagatacctttgttaagtaccaaatctcaaattggccctaaaatggagctctccagttcaagggaatggttgatcttccaaaaacaggcagatggtgaatccactaactcttataatctccaaggtcattgtaaagtaggaaaccgggaagcctggaagataagtaggcccatggctgtaaataaggcttccagttggcctgtgaggaggactttgggaacagcagctactatccatccttggccctgcctgagcctagctcctcatgctgcctaattcagaaactatagccatgtactcccagtccctctctcagcttctcccaccatctccagaaactgctgagggagggaaaattaacattaagttagaaccagcaagcattgaagaagcaggcaagcatcagaggtgaggaacaacctataagtcaataacaggagagtgagtcttttaggacaaaccttggaatgttgaccagagtctcaagaaaatgttttacgtagctgtgtgcttaaaaataactgagtttttgtcatagataatacaaatagtcaaaatttcatcctttagtccctctacctcgtggtgttaataataatgacagccaacatttattgagtgcttactatgtgccagacactgtcttaagcaccttatgcacatcatctcacaacttcatttaattgccacaacaattcccatggtgggggtgggtacaattactgttacttccagtttataaatgataaagcagaggttcagagtagtgaatgagttttcctgattcatacagctactgagtgatagagaaaggatttgaagcaaggttctctaacctcagaaccacatctgttaaccaatacactgtaataggtcttttccttcctttgactctttttgcttaaaccacaattgtataaagacttaagttgatgcaatagcaatggaagtgaaaaatattgtaagtgttttgtcttctttcatggaacaatgggtttagtagctgccatacccctttaaccatgtcagaaaagcatgaaaaaacagcatatattggtgtatcatataccgttattaaataataagccatattatatatgttattaaactatgaacagacagcagtagattttactgtggaaacttttgatagacgcacagcacaagtatctcataagcacaattttattagattcacatgtttattctgagatctgtgacatattcaggaatatacctcctgtgtaactgaggtaaagggtttctgaagccaggccttcttgtattttttcttccaggagggaactgaggttatagataggtgtatactccaagtacacttgatagagtgagctgtgccaggttgaggaatgagtttccattactggcttaggagggggtgaaagtgggggccacagaaggttctgaagcttgaggtgcacaatgctttttgtcagcttgctaccagtgtcagtgcaaatggggaaaggcttgatgtcttccaggacacaagactatttaagcttaacatcccaggaacatattcaatactgtccagagacttctctttctttatctgaacagatatttaatgatagaaaggtgtaggccagtgagtagtcaacaataggcaacgattctagagtactgactccctatgtactataattggctgtaatttgctcaaagattcattctaggcgcaggcactttctacatactccataccattaggcaggatcttgccaagatggagaccttcggacctgtctacatacagtggggtagctgtctgcccaactatgaccctcatgattatgccataccacactggacagctcccatccagcccggagctctttcctctttccttgacacatccctcagggcccttatccactgaatagcatgagcccagacagcacctcctcagaccaggttcacaccaccatactccaaggcaaccctccaggcacttatccatgctcctaataccaataaacagcctttgctcacaagagaagctatatcctaattgtgcatgtagtaagagctttcttgttaagatcacacattagctgtgatacacactgagacaagtctgctttccactagagtctaccttgcaattacacaatctggatactggcctttgtggcctacccagccactctttactcagtgaggcaacccttgtgcagattagagctctcagtggactctccaatacaacgaagcaggccctaccatcctgcccctctgcatgttgtgtccatccccaccaccagccaccacttcccacaagacaatcagcccagagactttaattgctgggtctgctgtgaggctggcctcaccagctctcaccttcactgcagcttatacggctgttttgctcacagaaaggcaaccatctccagaggaggatccacatctcaccatatgcccagtgaagccactttccagtgcccctagtcagtgctgcattatccagaaggccagataagtatgtgcttagagaataacactgtgggggcaccaatcaaatgatttttaaaagagttagaaatttgatatttaaaaagctgaagtagataagaaaaatcagagctgtgttggatttttttgtcatctgttgtatggcttataattgtttccatgtgaattacagagaggaaggtagacacaaaaatgttttcattaattagggcttccaaaggccctattttggccctgccctctttgtttctccatacactgtgagccagccatctgctaccatccaaaattcctcatgctattcctggaatagtaatcctaccacaaggaacaatatctattcagaatataccagtaaggtcacatcaggtgttaaaatattgaaatacttccatatctattgacgaagagccattgccctgatcccttcctctgcaaaccccctgcctccaccatcacctcagctgcactagactctccctaaggatctccgggcccccttataatctaacaactgaaggcataatacttgctccagcatcctgtttcaatgtttatactgattggtcagtgtccatgcagaatctgctgttaaatattttgaatatcaaatataggaaaggtcctataactgctgcaccaagcattatacagctttctggggctcactacttacatgcatatgtcacttggcaaatctcttccaaaccagagaggatttctgaacacttggtgcacattgtacaccaaccactagaccacactaccattccctatatttacatggactctttgccttgaggcaatctctgaataggcagcacctcagctgagctcttcatgaggaagtcctccagatacttaccaatcctgcacaccatgaggaaggttttaactctgcctcctcttcatttattgacttgacctgccattccctacttcccctataccttggcaacccatgatctggccattgcacattgcttcaaaacaaggaaatgactgacaagactaggtccacataggcaataccagtccttgcaaactgagacaaccaacctatgaccccgtaagagtccacatggaacatagtgtgttggctcctaatgtgggtcccacatcaactcttcacagagcatttggcaaaacttgaaaccaagatctgtaatacaatttccaacaattcaatggactttctaaatagtcaagtccaaaatcccttcttccccaggaacaattctctagctgtgtcaagcctgtgaaaccactcaggacactgactggagcagaaccacacctacttttcacacagcctgagctaatctctaaccagaacaggatctacatcaaccatcaacgctgaccaggcaatcatatacacagccactcctcatggcctgaaacaaaccctaactaggccagggagcaaacatcagtctgcaaaacttgaggcaaattctgagcagaacagaatcttgaaggagctgctaagatgactctagtccacagaagcagcctccatttcatgaaacagcctatgaacagaccaggcatatggtcccatgcctcacattcatctcctccctttccctcctcttccctctttctgcccctttcttctttcccattttctcccattccttgaccctgttattccctttctctctcacccaattcactgccatattatttagttgttataataattttgatctccctagtcacagggaggggaaaatctaggaaacttctaagatagttccagccccccaggcaagtctgctgttgaaagactgggcctactgtatgagaatcagtgcatggagtttatgttcctggaaccagaatggttgtggaacaaaaacctcttttctagtaagcaagcccccaagccagctgttatgatctgagaccagtccccaagtgaaaggctcaggttcagccagattgggagggaccagaggagactctgggtaaaaaagtcaagtagataaactcttccatacctcctgctattccaagttttggtctgccacattaggataaatatttgcttaaaaaatccctcatgtgtatgtttgttgtcaagcttttgcattagatactacacaaactataattcattgtccctcatgttccttgaacccatttctgcccaattctctccttttatcacattccttaagaccttttaattcatgtttatgtacatatataggaacctacacagagtactatttgtgtatggttttttaaatatatgctatgcagtacatatcattttgcaacttgatttttcactaggcattgtcttgaagatcttgtcatatacatatagacctagttcatttacataaattgctacataatgtggcatatgtaatcactctatgtaattattcctttcttaatggacatttaagttgtttccaatgttttgctattacacatagtgattccgtgaaagccttagtttctgcttccttgtgtaattgaactggagtttttctagagtagatactaagaatggaaatttctgggtcatagtgaatgtcccccctttttttactttaatagatactgcaaattgtactctcaagtggctttctgtatttacattccaataaagtgtgtaaacatgcatgtttcctcaatcctttgcatgcattttttcaagtttttattttgaaaaatttcaaacataaaattacacatctgacaaaggactaatatccagaatctacaaggaactcaaacgaatctgcaagaaaaaaacaaacaatcccatcaaaaagtgggcaaaggacatgaacagacatttctcaaaaggagatgtacaaatggccaacaaacatcaaaaaatgctcaacatcactaatcatcagggaaatgcaaactaaaaccatgatgaggtaccaccttactccttcaagaatggccatgattcaaaagtcaaaaaataaaaaaatataatttacaatgcatatccatatgatcaccacctagattcaataattaaggttccatgtctgttttatctacctatcttttttgatgaaccatttcaatgtaagttgtaaatatcatgattcgtgacccttaaatactttagcaagcctctaaaaataaggacattctcttacataaatgccagttattttcacacaatatcttatcatacctacaaaaattaacaataatttcctaatccttatatcatttaatatccagttaacattcaaatttcctcaggtgtcatcaattgtcttttttaatgttttattttgacagccaggatccagtcaagtttaactaattgcattttttaatggagatattattaacatactaaagagttcaccatttaaaatagaacaattcagtggtttttaatatattcactagattgtgcaaccatcatcactaattccagaacattttcattgccctgaaaaggaagcttgcacccattagcagtcactccccgctctcccctactcctggtcaccagcaaccactaatttactttctgcctttatagatttgcctattctggacaattcataaaaatggaatcatatagtatgtgccctttcatatctggcttcttttgcttagccatactgttctcaagattcatccacattgtagcatgtatcagtacttcctttttaaatagccaaataatattccattgtatggatataccacattttggtgattcatgcaacatttgatggacatttgggttgtttctaatttttggtttttatgagtaatgctcctatgaatattcctatacaagtttttgtgtgggcgtgtgttttcatttcacttgggtatatacctaggagtgaaattgttcagtcatatagtgactctatgtttaacattttgaagaacagttgaactgtttctgcaatggttgccccatttacattacaaccagaaacgtatgagggttacaatttctccaaatactcatcaacacttgttattgtctatttttttgtgtgtgttagagccatgttagtgggcatgagacggtatcttattgtggctttgatttcaatttccctgatgattaataatgttgaatatctttttgtagtttttcaccatttgtatatcttcattgaagaaatgttcattcagatatttgccatttttaattgtgttatctttcttatggagttgtaagtgttccttatatattctagataaaagtgcttcaggagatttacgatttacaaatattttcttccattctgtgggttgtcttttcatttcttgatagtgccctttgacacacacccaaaaaaagtaattcaacttattgagtttttttctttggttgctttcacttttggcatcatatttaagaaaatgatgcctagtccaaacacaaaatattgacccctatattttcttctgagtttcattgttttagctattacatttaggtctttgaccatttcaagtaaagttttgtatataagacagtggtcaaaatttattcttttgcatgtggatatccagttgtctcagtaccatttgttgaagaaactgcttttctcctttgaatggtcttggactctcaattctgttccattgactgacatagctatctatccttatgccacttggttactgtcactttgtagtaagttctgaaactgggaattatgagtcttcattttagatctttttcaagattgttttgcctatcacgaggccctggtatttccatatgaattttaggatcaacttttccttttttttttttttttttgaaaaaaaaggccattggaggcttttgtttgcttgtttgttatgtttttgatacagggtatcactttgtcaccgaggctggagtgcagttgttcactgcagcctttaactcctgggttcaagtgaccttccacttcagcctcccaagtatctagaactacaggtgtgtaacaccatgcctggctaattattattatttttttgtaatttttttgtagagacagagtctcacaatgttgtcctggctggtcttgaactcctggcctcaagtgatcctcctgctttgacctcccaaagtgctgggattacaggcatgagccactgcacctagttaaaaaagagcattagagttttgatggggattgcatcgcatctataggtcaatttgaagagtgttgccatgttaatgttaaaccttccaatccatgaacataggatgtcttttcacttatttaggttttctttaatttcttccaacaacgttttattgttttttttgtgtacaactcttgcactcctttgcttaaagttattcccatgtattttataatttttgataccattataaaagaaaatgatttattaatttcattttctgattgtttattgctaattcatagaaatataattgtttttctgctaatcttatatcctgcaaccttgctgaacttatttgtctaacagttttttagtgaattcctcaagattttctatatacaagattatgttattcgtcaatagaaatagttttacttctttctttccaatctggataccctttatttgtttttctggcctaattgctatggccagaatcctcagtacaatgtttaataagagtggtgagagtagacattcatgttttgtttctgatcttaaggagaaactttcagtcttccattattaagtatgatgttagctgtgagtttttcatcggtgtgcttcatcagattgaggaactttccttccctctcttgtttgttgaattttttttatcatggaggaatgttggtctttttcaaatgctttttctgtatctattgagataatgtggggttttcccctttattcaactaatgtgatgtattacattaattgattttcgtatgttgaatcaatcttgtattcctgaaattaatgccacttggtcatggtgtatattcctttttataagctgcaggatttaatttgctactattttgttgaggatttctacatctctatttataaagaatactggtctatcattttcttttcttgtgatgtctgtctggttttggtatcagagagatactggcctcacggactgggttaggaagcgttccctcctcttctggttttggaggagtttgtgaatgagtagtgttaactctttaaatgttttgtagaattcaccagtgaagacttcttgtcctgggcttttttttaattgttaattcgatatttttatataagtgtgttcagatttataatttcttcttatgtcaacttgatcttctgtgtaattcattgcattttgttatgtctctttagaatcttatgccacaacaatactcccacattttccaccccaggacattgacttttaaagacatcaggttgccttgtagaccgtcttgcattctggatttgtctgattgtttcatcaagctgtcatttaacatgttctttgctttgtatttactataacctgaaagttacatataatgtcttgagcagagtcaaatttaacatttttattgccaatacttgatttttttaaaaaaaattacattttgaaaattgatagatgaaggtgagagctcatggttaattagtggtaaaattgaatagatttttagacttattggccatttgggtttcttattccgtgaactgttggcttttattctttgcctatcttgctattgtgttgatcatctttgtcttattgatttgaaggtgtttattattatattctagataaaaatcttatccacatttttcatttacttcttcaattcacctgaaatttatttttgcaaatggtatattttaggcaagaatgttatttatttaaatgtattttttaacttatttaaatcaattttatctattgtccagataaaatgtattgaatagtcgggcttttcattgacttgagatgtcacttttattatatactaaattcccatatatacatgaatcagtactttttattatgccctattgatttatttttgtctagtcatgtgaatacattttaattacacaatgtataatatgctttgatatctgtaaggggaagtatctcatatatttttaaaattgtcttggctattcttgtacattcacttttcttttgaattttagagttcgcttgtcaaaccttaggaaatatcttttttattatgtagattgtcattgcattcatcttataagattacttttgtgagaatttatatccttaacataatgagtcttccatccataaacaggccctttttcatgttgttcagtacatttttgtagttttctccgtaaaaactttaaccatttttggtcagatttattcctatttatttcagagcttttttgctgttataaatgatatttgcttttctattacattttccaattggttattattggtgtataggtaaactattaattttgctttgtgaaccttatactcagtcacttgttttttttttagagacagggtcttgctttgttgcccaggctagaatactgtggcacaatcacggctcactgcagccttgacctcttgagctcaagggatccacctgcctcagcctcccgagtagctgggactacaggcacccaccataacacccagttaattttttaaattttttttgtagagacagggtctcgctatgttgtcccagctgaacttgaacttctgggctcaactggtcctcctgccttggcctctcaaattgttgggattacagctacgaggagtcaccacactgagctcccagtcacttttaacaatgcactaagctctaaataatttgtcacttcatttttaaacctattttttctctctcattgcattggctaggatatctagtaccactggaatagtaattgttaatgatcacccctttcttctatttcattttaatgagaatgtttctaaattttcatgattaaagtaggtttgctgtaggtttctagtagataagtttatgaagataagttggtcctaatttactagaagatttgttaaacgtgaatgtatggtatactgtgtgtggtacgtacaaacttgagaccaaataccacatttattagaaaataattcataggcagcatgggcccctgggctgaagagcactggcctcagttggactgaactctgagaagatggaatctgccaattgaagccagacatctgtagaatctagaagtgaagaatttcccagagagaggtctctgggtataccatacaacctcaggcttaccaggaagtagcatcttgcttgcaagaagagaggaagaaagggctggcctggagggcgtccaggctcagcagatcatattcctactacagactgttgcctgcccacctgcctgcctgcctacctgccttaggttatgaagccaattaggaacagaagaggataaagaactgtgatttgttccactttccaactctccattaaactgtagaacccatgggtaaggaaattactttttttttttttttctgcctcagaagacaaagagcattcccttggagattgtcatcttgtttttatggaagccactacctagagttgaatagctttcccctttccatgctatactgtcagcagtgccacatgacatcttcaactactgctacctaaaaaaaaactcttacttcctaccctagcctggaataaccagtggctgaagccaaatgcctaagaggtgctttcctcaaaagaatctctgtctcccacacttctgggaaataggtggaaagcagaatgaaacaaagtgttccttagtccagttgtagtcaaatggaagaactgaatatttatagacctggatttcttatactagccccttccctcacttgctgtgtgagttgggccaaatcacctaaactctctgtgcctcagtgggagagaggacaaaaatactatctaccccaaaattcattgcaatgattgaagaagatttgtataaaatgcttagcaaagagtctagcaatttaagagttcacaaaatattatttgttaaaatgcaaatgaatgagattgtgagaatgctcagagagtgacagggaagaagagccccatcttattccatatctatctatctccagtgacatgcaagcagatactaagttatctaaatctaactaaagagaacaaagattccccacagataccttcagtagccccatgctttggattcaaccatctctttttatagggaagggcagacacatgaaactgggcattcattgcaaaagcaatgactccttcgagaccagcctggccaacatggtgaaaccctgtctctactaaaaatacaaaaattagctgggtgcagtgggggtcacctgtaagctacttgctaggctgaggcaggataattgcttgaaccctataggagaaggttacagtaagccgagattgcgccactgcactccagcctgggtgacagagactgtctcgaaaaaaaaaaaaaaaaatcaatgactccttaaacatggaaagaagctctatattcctcaatattgaggccgctgaagaaaaataatcaatggatacctctactgctcaagaaagctggactccaagactaacttgattcaacccctgaataactacaaaattatcctggtttcccagggattttattagcaagaggaacagaacaatcaagactgatctagactacagacccctttgtgtaccctgagctatgctactctgtttactaatatgaacatcagaatgccttgattgcttaaaggagaaactaggtgttatgtataatttgggctctgacatgctcctactttagacgaataatttcttatttgaagaaagaggatgatactgcgaatcatatatctttccacaggactcgttgaggaagaaaaggagatcattttatttatttacttattttttattatttttaagaattttaacttttattttagattctgggggtacatgtgcaggtttgttatctgggtatattctgtgatgttgaggttttgggtacatttgatctcatcacccaggtagtgagcatagtaccaaatagttgtccaacccttgtgcccctccctccctccctccccctctagtagtccctagtgtctattgctgccatctttatatccatgaatacctaatgttcagctcccacttataagtaaaacctgtggtatttggttttctattcctgaattaattcaattaaataatggtctccagctgcatccatgttgctgcaaaggacatgatttcattcttttatatggctacatggtattctatggtgtatatgtatcacattttctttatccaatccaccattgatgggcaccttggttgattccaagtctttgctattgtgaattgtgctgtgatgaacatacaagtgcatgtgtctttttggcaaaacagttattttcttttggatatatacccagtaatgggagtgctgggttgaatggtagttctgttttaagttctttgagaaatcttcagactgctttctgcagtggctgaactaatttacactcccaccagcaatgtataagtgttccctttaaagacttttggtggagtctttaaggttgtctaggtatagattcatgaaggtatagcattgtccatgaagatagatagttcaacttcttatttttctatttggatgccttttatttctttctcttgcctaattgctctggctaggatttccagtactatgttgaataggagtggtgagagtgagcatccttgttttctttcagttctcaaggggaatgcttccagcatttgtccattcagtatgacattggctatgggtttgtctagatggctcttattattttgaggtatgttcctttaatgcctagtttgttgtgggtttttatcatgaagggatgttggattttacctaatgctttttctgtgtctattaagatgatcacgtttttttttttgtttttcattctgtttatgtggtgaatcacatttattgatttatgtcaaaccaaccttgcatgccaggaattaagcctatttaaatgtggtgaattatctttttgatgtgctgctggattcggtttgctagtattttgttgaagatttttgtgtctatgtttatcagggatattggcctgtagttttcttttttgttgttctgtctttgctgggtttggatatcagggtgatgtttgctttgtagaatgaattagggaggagcccctcctcttcaatttgtttgaaatagtttcagtagaattagtatcagctcttctttggctatctggtggaatgtggctgagaacttatttggtaaggggctctttttgattggtaggttttgaattgctaattatgtttctgaacttaatattaatcttttcagggttccaatttttttcctgactcaatcttggaagattgtgcattgccaggaatttatccatttagtctagattttctagtttgtgtgcatataggtgtccatagtaatctctgaggatcttttgtatttctgcgggatcagttgtaatgtcatctttgtcatttctgatcatactcatttaagtctttttctttcttaatctaactagcagtgtattgacgttgtttattcttttgaagaaccaacttttggtttcgtttattccttgtatggatttttgtgtcacaatttcattcagctctgctctgattttatttatttcttttcttctggtagctttgaggttagtttgttcttgtttttctagttcctctaggtgtgatgtcagatcagtaatttgagatctttctaacttttttaggtagttggttagcactatcaactttcctattaacactgcttttactgcatcccagagattttggtatgttttgtgtctgttttcatttatttcaaacaatcttttgatttctgccttaatttcattgtttactcaaaaatcattcagaagcaagctgtttaattttcacataatttaattttcacatagttgtgtggttttgagagattttggcattgatttttattttgattccactgtggtctgcaagcatggttggtatgattttgattttttaaaaatttattgacacttgctatggccaagcatgtggtccatcttggagtatgttccatgtgcagatgagaaaaatgtatattttgtggttggcaggtggagaattctgtaaatgtctattaggtccaatatgtcaagcgttgaatttaagtccagaatttctttgttagctttctgcctcaataatctgtctaatgctgtcagtggggtgataaagtgccccactgttattgcatggctgtctaaattgagaaatagataattttaaaacaaaacaataacaatagttgtactgcaataatgctgccatttaataagcatatagtccgtattgtgtcattcaattctcttaacaactctgtgagatatgtactattaacttgtctatacaacatatgagaaaattgaagctgagagaggttaaataacttgctcagagtctcatacgtaatatttttaagtttctattgctattgcaaatgatatttattttcctatcatgtaccctaataagttgttgatgatgtgtaggaaaggtattgatttttgtagtctgatatttcatttaaccaccctcctggacttttcatatttgttctaatattttatccgttgactacctcagatttttatatagccatattgtttgtgaataacaaaaattttgtctcttgctttcgaatccttattctcttatttttaaatttattttataccttattgcattggttaggacatcaccatgttgaatagtaagtggtaatagtggccatctttatcttgtttctcattttaatattttgtcaataagaactaccaatagcaattcatatttattgagtactttatattgcccgagtaagtgcctttatatattttatatcgtttaatccttgcaacaatactatgaggagtgtactattatttttctcattttttgtggatgagaaaagtgaagctcagaaagagtaagcaattttccaaggtcacacagcttggatggaaccaagatcctaactaaggcagtctgactccaaagcttgtactcataatcaaaattacctcctcagaattttcacaagatttgttgaggaagttctcttctaatctttattggctatggatttttaacatggatggacataaaattttgtcaaatgtgttttcaacatctgttgagatgattatgtgatttgtctcttagtctataattgtatttaattactttaataaatttgctaatgttaaactatgcgtacattcctgaataaactctacttgattatagtgcatcattttaataagctgctagattctattttttctagaatttttatatttatattaataaataagattagtctataattttctttttctttcttgtcctgtctgtctgatttggaggagccgtccatcttgttgtaccctctggaactatttctataaaattaaagttgtctgtgatttgaaggtttggaattacccataaaatgtttagcctttcaatttgttctattatttttctatgattttctactttttattgggtaaattttagtaattttatttttctaaaaattttctcattgaaacatattagtttaaaattctatgtagtattattttatttttaatattaccttggtacctatatttgtgttcatatttggcttcctggtgatattttttcaccttcttcattttttcatattagtatttaatgaaggtttgactcttaaaaacagtctcgttttatggatcatctataatttatttgttttctatttaacagttttctgtttttatcttaatctctcccttccaattcccataggcttgttttatttttattttagctttcaagacagagtctggctctgttgcccaggctggagtgcagtggtgcagtcatggctcactgcaacctctgtctcctgggctcaagcaatcctcccacctcagccacctgagtagctgagatcacaggtgtgtgccaccacgctggctaatttttgtatattttttgatagagactggtttttgccatgttgcttaggctggtcttgaactcctgggttcaaacaatctgcccacctcggcctcccaaagtgctgggattgcaggcgtgagccactgtgcccgacccatgggtctatcttactgtgctgttttgtaaaactaacacctggacttgatagcttagttcgttgacttttcatttgtttataatttctaatatgtgaatttaaggccatgtttttctctgaatattgctttacctgcatctaacagacttggatatatacttcactcatcatctttgattgctaaagcatttgcaatatcaatttaagttcatcttcaattcaagagttatttaaaagtgtgtttatgtttttaatttatagatatatattgcgttgagcttgtgtaatgggagtggggtagttggttatcactttactgctgatttctaattacatttcagtcctgcatagctgatttctgagcccgtattctcaatcgatacaaatggtaatagtctgtcgcagtgtgtgcctctatttcccaatctagaggcagtgtgatgttggcttttttatattcagcaccacctgagagtgagcatttaaggatgtgagaaatgagacttaatgtcagttctcaggagtcagttggtccacttagagacatgtagtccctttcttacagacccctcttcacgtttggaaagaaggtgtttgtcttatgagccctctttgtcagtcaggacacatcatgttgacttatctaatcctactggtttgtagctacacttcggtttctgggtagttggttatgggcatatcccataggttgtgtggcactgaggaagtagaatattcaaagtcctgtcctggagaaaaaacaatccatctgtccatggaggctaagagttctagttagtttttcttccagttaactccactgccttcttgctcttcaaacctactgtttctaacaaagaggatgatgtatatattaccttctatattactatatatttagatattcttagcaagatacaaacaatacaaaatatgtatttgtcttgcttagcagtctagatgaatgcttcatctcccttggtgcctcatctgtaggaacacagtatcattgccttgtgacacaagtctgtatctcgtatctcatatctcagaacaggggcctcctttagactgctttcatggtctctatctcctcccactgctactggcaatacctttactgacacctcacacatacatcctgagaatagtggggtttaatttgttttccaaatgaatagggttgtcccctcccccaagtggactccagaacagtgtttcctttctgtgacacttccattgtttttaatgttcttacttccttgacgacccttaattggggtcttttgcagactgagactgactgcctttttcattttctcttctgtatcactaatgacagtgcagaataaagtggtacctaacattgtgttctgctaacctttctgccagatagccctatgcattgcattatctattagtttttttctgttttatggtcaattttctacccattcaagccactaaaaaatgattttccattatatgggtacaaggtaatcctgagacaaaacaaacaaacaaacaaacaaacaacaacaacaaaaaacagaccttcagctgtgattccagggtagggtagttgcaccaacccacagctgttatgaagcccctatctttatatagctgaatttgatcatttatatggacaacagctgaatttgatcatttatatggacaacagctgaatttgatcatttatatggacaatgcaggttagtcttcaactgtgtatgcttccagtgaggttacttgtactctgtgattcaaaaagttctggtcatttgtctaggccacagcattcctcaaaaagagacatgatacctttctaaggctgagccacatttgctgtagaaaaatctttgcaattcctttgcagcagggaaatttttgcaactcaagatgaagtggggcagggcgagaaggcttctttgactgcaaaagtatctgaaacgaagggtaaggcctttgtgtacttgtagtcatcattatacttcatgaatagctctttcaaatgaatcatattaatagatctcttagaactggaagggactttgaggctacctgatgtagttcccttctttcagctgagaacgatatttctttaatctccattttataggtgaggcaactgagttccacaaaaacaatgccattctgtagtctcaggttcacctgaaaacattgcatttgactctgccactgttcatacttagcccaccttttgatagtctgtcttattcactgctttgagctcatgatgctctccaaagagcccaaccaggttgttacatgctgtgcccctggtagggagaattttcatacctgactcccataattgagggcagatatgacacattcctgtttgccgatagagaattgtatcctttaatgaagcaatactttcctgagcctctggagctgcatgtggttctttcacatgcaacctgtcatttttccaaccctttgatgtattaaaatattgtttccagtgatatttcacagtgcacatgtaattatcaggtattggactctagaatttgtgtaagttgtcccatctaatgggacagtctattccttgcttacaccattcagctggatgctaaaactgttttgggaattttcacctacacccttgacaagactagttcagtaaggccatatttggtctttggaaacagaaagaactggattcaaaccttttctccactatgaaacagtgaccacataagtagctgtgttacctaggaaacatcactttaagcattctgtgcctaaatttccttatctttaatggaatattagtaatgtatgtctcatgggtttgttgagagaatagagataatgtacatatggaatttagctcacataatgactaccacatgtaaggatttaatacactattattattgttctcctcctcctcgtcatcatctctctatatttcagagttgctataagattcttaaacaaaatggtgtaaactatatagcagtttctcatctctagtagagtctcaaaaatagcaactcttatgagtatagttaattaaagcactggaaatattaaatgaagctgtcacatttcttgaacatggcttatttggtcacacaggtggtttatcttgaacaaatagtactgttcaaattttctaattcaagtccacatgttccagccagagagtagagtggtaaacatcatagaatcctttagaaattgatactttctctgaattttcccattaagtttctcagttttctaaatacaagactaaaacacactcccagaaaataatttcatttgagtgtagaactgtgacaaatgatatcaccaaggtagctaacaaacagatacacataattttcaaggcaagatttctagatgttctctggttacttggtcttaattatcctttgatgtcagcaaccatctgctcaccctttcacatacataattacccagccaaacttgtacactgtactggaaatttcaaggggttaagattaagaaagaccttgattctacttgcaatctccactacttgctagctctatgtccttggccaagtctcctaatgtgtctgaatatcagttttcatatctacgaaattgctataaaaatcatttcccaaccacttatccaaaatccttggtgccaaataagttttataattcaagttttgtgggctttttattttaaaaatactgcatgttgcataacaccttcagtgggacagaacccggtaatcaatcacatcaatatttctgcaacaaagcatatgaatagttacactgagagtgcctcatgtcaattcacaacaagttttgtcaccaggcaagttttagcaacaaacttatgaaaaactgtttggtcttcagagctttctagagtttgtaattattaatggtggactgaaacttgtatctgatcacatgagattgttctagggattacatgaaatgcattatgtgtagcaggggtcctgatgagagtgaattgatattctgacacatctgggtatgtgaagacccccatatgtttattttcttgagataatctgcagaaggcaaaaggctttatgcagaggagggctgtgtcagaaactgaatttgtagggatggaggagcaatctgataagatatgatggtgtttgttctccaaggacagtaaccaagtttgaaagtctgagctagggtggtgggagtgggttgttggggagatgttgctgcagtaagaagctgaagatgtttttctcacaggagcctcactcagatacaggttagaagcaatattgtttcagtgtccaggtgacaaaattatagcacagaactgaaaggggcattcctacccttctatgtagacccattgttggtttcagacaaagctgccagaaaagagggcagcaccatttaagcccctcagggatgtgtagctgggagcacttcagaatccatactcccccacagtctagcgggggcctccatgttcccacagccacaggtactagtaccatcagtagctggactgggttggaggggctaccactatctttcattagaaacacaagctctgtctagtgaaaatggacacataacataccaaaacttatggaatgcagcaacgttccctattaagagggaagctgatagtagaaaatgcctacatcaaaaaagaagatcttaaataaataacctaacattacacctcagggaactagaaaaaagaacaaactaggcccaaagttggtagaaggaaagaaataataaaaatcagtacagatacaaatgaaatggagaatagaaagtcagtagaaaagatcaataaaagtaggagtggtttttgaaaaggtatacaaaattggcaaatgtttagctagactaagaacaaaggagagaagactgaaaatcagaaatgaaagaacacattgcaactgatgactaaataaaaacaaatgatcataagaatctactatgaagttatatgccaataaattagataacctagaaaaatggatacattactagatacatataatctacaaatgttaaatcatgaagaaatagaaaatatgaacagacaaatggtgagtaaagacattgaataagaaataaatagtcccacatcaaggaaacgctcatggtctgatgccttcactgctaaattccaccaatatttagagaactaataccaattcttctgaaactctttcaagaaatctaagaagagggaatacttccaaactcattttatgaggccagaattaccttgataccaaaaactgacaaagacataacaacaataaaaaattaactgcaggtcaatacccctgatgaacatagatgtaaaaatcttcaacaaaatactagcaagataaattcaacagcacattaaaaataacattctttatgatcaaaaaggatttatctctggggtgctagaatagttttacatacacaaattaataaatgtgatgcaccaattaaaagaataaaggacaaaaaccatatgatcatttcaatagatacagaaaaagcatttgacaaaattcaacattctttcattataaaaactctaaatacattaggtttagaaggcactatgatttggatatttgtcccctccaaacctcatgttgaaatatgattcccagtgttagaggtgggggcctgttgggaggttattggatcatgggggatgatccctcatgaatggcttagcaccaaccctttggtgataaacgagttcttgctcagttagttcatgtgagatctggttgtttgaaagagtctgagatctctccccttgctctcttgttctcactcttgccatgtgtcatgcatgttccccattcatcttctgccacgattataagcttcctcaggccctcacccagaagctgagcagatgttggtgccatgctttacaggctgcagaaccgtgaactaataaaccattctttacaaattacccggccccaggtattcctttatagcaatgcaaaaatagcctaatacagaaatttgataccaaggagttgctgtaaagatacctgaaaatgtggaagcagctttggaactgggtaacagataaaggttgaaaaatttgaatgttgcagaagaagacagaaagattagggaaattttggaacttcttagagactcattaaatggttgtgaccaaaatgctgatggagatgtgggtagtgaagtccaggctgatgaggtctcagatgtaaatgaggaatttattgggagctggagtaaagatcattcgtattatgccctagcaaagaattaggctggattgtgttcatgccctaggggtctgtgtgtgtttgaacccaagagtgatgactttgggtatctggtggaaggaatttctaagcagcaaagtgtttaagagatggccaggcagcttataacatcctacaatcagatacaggagcaacgaaatgacttaaagttggaactcatatttaaaagggaagcagagaaaaaaaatgaaaaacttgaagcctagccatgtcacaaagaaggaaaaggtattttcaggagtggaattcaaacaggctgtggagcaatttagattatcacaactaaaagggagccaagtgccagtgtccaagataatggggaaaaggccttgaaggcatttcagaagtctttgggacagctcctcccatcacaggcccagaggcttaagagtaaagaatggcttcatgggccaggcccagagtgccaatgccccgtgacacctcaggaggctgcttcttgcatccctactgctccagctccagctgtggttcaaagggccctagatacagctcggaccactgcttcagagggcacaagctgtaagccttggcagcttccatgtgatgttcagtctgcaggtacacagaatgcaagagtgaaggaggcttggtgacttccacctagatttcagaggatgtatgggaaaacctgaacaaccaggcaacagcctgctgcagtagcagattccctgacagagagcctctactatggcagcaccaagaggaaatgtgaggttgcagcccacactcagagccccaaccaggtactgcctggtggagctgtaggaagggggttgctgccctccatacacaagaatagttgagccagcagcaactcgcatcctcagcctagaagagccacaagcactggactccaacccatcagagcagctacatagtctgcatctagcaaagccacagaaatgaaactgcccaaaaccttgggagcccatccctcataccagtgtgccctggctggtggacatggagtcaagggagaatattttggagctttaagatttagtgactacccttctgggtttagacttgcatggggcctattgccctttccttctagccaatttctccattttgtaatgaaaatgtctggtcaatgcctataccgccattgtaccttgggagtgaataagttgttttttttatctcacaggctcataggtctccagatgagactttggactttggagttgggacttttgaattaatgctggtatgagttaagtcttggggggactattgcaaaggcatgattgtattttgaaatgtgagaaggatgtgagatttgaggggccaggggcagaattatatggtttggatattcgtcccctccaaatctcaagttgaaatgtgattccaatgttggaggtgagacctgttgggaggtgactgaatcagaggggatgatctctcatgaatggcttagcaccatactctaagagaaaagtgaattattgtgcaattcatacacgtaagatctggttgtttaaaacaggctgtgtcctccccgcttgctctcttgtttccagctcttgtgatatgatgtgtctgcttcccctttgccttctgccatgattgtaagcttcctgaagcctcaccaagagcagatgccagtaccatatttcctgcacagcctatagaactgtgagccaaaataaccctcttttctttataaattacccagtctcaggtatttcttgatagtaacacaagtgaactaacacagaaggaatgtattcaacacaatgaaggtcatgtatgacaaacccatagctaacatcatacttagcagtgaaaagttgaaagctctttgtttacaatcaagaacaagacaaggatgtccactcttgccacttctgctcaacctagtactggaattcctagccagagtgattaggcaagagaaagaaataaaaggcatcccattcagaaaggaagaagtttaaatggtttctgtttgcaaatgacataatcttatatatagaaaatcccagaaactccaccaaaaaaaactcttggaaattataaattcagtaaggttgcaaaatgtagtactgctactatacactaataatgaactatccccccccaaaaaatcaagaaaacagtctcttttataatagcattaaataacaaataagatatactatttaggaataaagaccaaggaggtgagagatcgctacactgaaaactataaaatattgatgaaagaaattggagaagatacaaataaatggcaagatgttccatatacatggattggaaaaactaatattgttaaaatgtccatactacccaaagcaatccacagattcaataaaatccctatcaaaattccaatgatattttttcacaaaaatagaaaaacaatcctaatatttgtgtggagacacaaaagagcctaaaggaccaaagaaatcttgagtgaaaagaacaaagctgtaggcaatacaatgcctgtcttcaaaatatatcacaaaactctattaatcaaaacagcatggtactggcataagaatagatatatagaccaatggaacagaatgaacagccaagcaatagacccacacatttaaggtaaattgatttttgacaaagatgccaagaccacacaatggggaaagaacagtctccttaataaatggtgcgggcataacttgatatccacaggcagaagaataaaattagaagcttcactcataatatacacaaagactaagtcaaaatgggttgaagacttaaatataatacttgaaactgtaaaactactagaagagaatatagggaaaaacctctgtgacattgatctgggcaatgatatttgacctatgaccccaaaagcacagacaactaaagcgaaattagacaaatgggattacatcaagctaaaaatttctgcatagcaagggaaacaacacagtgacgagacaccctatggaacgggataaaatatttgaaaaccatgcatctgatgagggattaatatccaaaatgtataagaaactcaaacaactcaatagcaagaaaacaaataacccaattaaaaaatggaaaaaggacctgaattgaattgacatttctcaaaacaagacatgcaaatagccaacaagtatatgaaaaaagctcaacatcactaatcaacagggaaatacaaattaaaaccacaatgagatatcacctcatacttgttagaatgactattatcaaaaatatggaagataagttttggtgaggatgtggagaaaggggagcctatgtaaggcacaccttcttttattgtactttgtttaattgtgctttgcagctatcatagttttttttttgttttgttttgtttttttttttttacaaattgaaggtttgtggcaacactgcatacatcaagtcattcagcatcattttccaacagcatcttctcacttcacatctctgtgtcacacattggtaattctcacaatatttcaaactttttcattattcttatatctattatattgatctatgatcagtgatactactattgtaattgttttgaggcaccatgaactatgcccatataagatggcaaacataatcaagaaatgttgtgtatgttctgactgctccaccaaccagctgtcctcccatctctctccttctccctctcctaagccctgcctattttctgagacacaacaatattgaaattaggccaattaataaccccaaaacagtctctaagcattcaagtgaaaggaagagccgcatgtctctccctttaaataaaaaactagaaatgattaagcttagtgagaaaggcatattgaaagccaagatagacctaagctaggcctcttgtaccagttatccaagttatgaatgcaaagtaaaagttcctgagggaaactaaaagtgctactccagtgaacacatgaatgatgagaaaacaaaacagacttattgctaatatgggcaaagtttgagtggtctaggtaaaatgtcaaaccagctacaacattccctttagcaaaagcctaatccagagcaaggcctaactttcttcaattgtatgaaggctgagagaggttagtaaagtgccaaagaaaagtttgaagctagcagtgattagttcacgagatttaaggaaaaacgccatctccataacatgaaactgcaaggtgaaacagcaagtactgaaggagaagctgcagcaagttacccaaaagagctagctaagatcattgatgaagatggctacactaaacaatgaattttcaatataacaaaacagccctctattgggagaagatgccatctaaggactttcatagctagagaagtaaatgtctggcttcaaagattcaaaggacaggctgactcttgttagaggctaacgcaaccagtgactaagttgaagctaatgttcatttaccattctgaaaatcctagggcccttaagaattatgctaaatctactctgattatgctccataaatgaaagaacaaagcctggatgacagcacatctctttacagcatgatttactggatattttaagcccactgtttagatacactgctcagaaaatgattcctttcaacatattactgtttgctgacaatacacctggtcactcaaatgttctgatggagatgtacaaggagattaatgttgttttcatgcctgctaacacaacatctcttctgcagcccatggatcaatgggaaattttgactttcaagtcttactgtttaagaaatacattttataaggttataactgccatggatagcaattcttctgatcagtctggacaaagtaaattgaaaaccttctggaaaatattcaccattctagatgccgttaagaacatttgttattcatgggaggatatttaaatatcagtattaacaggagtttggaagaagttgattccaaccctcttagatgactttgattaggtttaagacttcagcagagaaagtcagtgcagatgtggtagaatagcaaaagaactagaattagaaatggagcctgaaaatgtgactgaattgcttcaatctcatgataaaaattaaacagatgaggaattgcttcttatggatgagcaaagaaagtggtttctcaagatggaaagtactcctggtgaagatgttgtgaagattgttaaaataacaaaggatttgggatattacatgaacttagttgataaagcatcagcagggttggagatcattgacttcaattttgaaagagttctgctgtggataaaatgttatcaaacagcatctcatgctacagagaaatctttcacgaaaggaagagcccattgatgtggcaaacttctctgttgccttattttaagaaatttccacagccccccaatctacagcaaccaccaccctgatcagtcagcagccatcaacatgcaggtaggaccctccatcagcaaaaagattatgagtcactgaaagctcagatgatcgataacattgtttttaacaacaaagtacttttaaattaagctatgtatattgttctttagacataatactattgcatacttagtagactgtagtattatgcaaatgtaactttcatatgcactgagaatccaaaacatttgtatgaatcacttcattgcaatatttgctttaattgaagtggtctggaaccaaaccgtcaatatctccaaagtatacctgtacactgttggtaggaatgtaaattagtacaaccattatgagaaacagtatggagggtccacaaaaagttagaaatagaaccactatatgatccaaccatcccagtactgggtatatatttaaaggaaatgaataaatatgttgaggatatagctgaattcccattatgtgcagcattattcacggtagtcaagatatgaaattagcctacgtgtccatcaatggatgactggataaagaaaatgtagtatatatacactatggaatactattcagccttaaaaaggaaggtattcctgtcatttgtgacaacatggatgaacctggaggacattatattaaaggaaagatgccagggacagaaagacaaatgctacatgatctcacttatatgtggaattttaaaaagttgcttaactcagaagcagaaagtagaatagtggttaccagaaccggggggcaaggactggggagatgttggtcaaagggtataaagtttcagttagataggagaaataaattcaagagatctactgaacaacatggtgactgtagttaataagaacatattgtattcttaaaaattgctggccaggtacggtggctcatgcctgtaattccagcactttgggaagccaagtgaggtggatcgcttcagcattcaaactcttgagctcaagagttagagactagcctgggcaacatggcaaaaccccatctctacaaaaaaatacaaaaattcaccaggcgtggtggcacatgcctgtactcccagctacaggcagaagtgggaggatcgcttgaacacaggaggttgagatttcagtgagctgtgaatgaaacactgcattccagcctgggtgacagattgagaccctgtcacagggtctcaatagcaagagaactagaattagaaatggagcctgaaaaatgtgactgaatttgaaagaaaattgctaagacagtagatttttaactgttcttactataaaaaaaagataagcatatgaggtaatgcatattttaattaggtcagtttagccactctacaatgtatacatgtttcaaaacatcatgttgtacagaatatatgcaattatttatcaattaaatatatatgttatatgttatatatgtcatctagaatttttcctgacagatgatagacatttagcaatgtttttaaatggatgatattctcctgtatatttttctcctccttccttgatacctgactgtgagtttcttaaaggcaaggagcatggatatagttctagctttgtatcttctatgtctagcatgcttcttgacacacaataggtgttcaaaaataaaaggttgttcattgcatttaattgattttacattttaaaattgataatacattttaaagacaaaaaataagtcataaaaataagaccatcacaatgaaaaattacgaagaaaataaaattaaaaaaaatgaaagttccttaataagaggaaggcttttggctgtcgtggtcccctctggatccccagtaactgagcaactgcttgtgactaagaaacgtttgttgatcgaatttgttggcagttgacattcacgaagagagtgagagtggaagaacaatatgaaaggactgttcctgacaactattagaaataactgggtagagcttaagggggactgaggctctctattacataggtggggatacaagtcagtgaaatttgagttatgaaagtgcatgccatttcatttgtaatcaaggtgaggtatggcctgaggaaacttgaggcctaacactttataaaggttcaaaaatgtcttctgttgagttctgggtattagatagctaagcttcatgtagacaccaagtgggtcttggaaagtttctcattataaagaagaccttgggggtggggtaagtgtggacaaacaagggcttattctggcaagttctcattgggcttagttgctccatttgatctttgtgatgttactttggaagaagaaaggggcaatagtcattggttgggaaaacaggaaaaaggaaaccagttttacttggattattactattaaggtgaattcatttgcacccatgccctggctaagcatggggaaatgcaagtgatatatgtcaactatctagaatttttcctgacagatgatagacatttagcaatgttttttaaactgatgatattctcctgtatatttttctcctccttccttgatacctaaccatgagtttcttaaagtcaaggagcacggatatagttctagctttgtatcttctatgtctagcatgcttcttgacacacaatagatgttcgaaaataaaaggttgttcattgcatgagacatgttgatgattaggatatggattattatatgcaaattagtgccaaagaaatatttaaaagaaattattttctcccaaggtgatttaatcccatctgatatgaacactaataatttgcttagctaacagttttttgtttgaaacgcaaaaggtaagtttattccaccctaggtctgggattattacaaaactgagttggctagatccaaatgaatgtggttttcctgtttggttttcttgtcatggctttttactttcctttcccataaatcaaaatacagcacagaaagtctttttcttcataagatttggtatgccatggctactggtttcagttggctcacatttcctaagtaatcccttacctcattctggttcatggctatttttaataaggccttcatgacttgctgctctcctaaattagtttattcatttgtctgcaacttgactttaaaaaggctccacttgaggaggctcaaatcattattcattccatatcctctctcacttatgacaaggctagattttgttccctttctctgttcccagatttattcatatgaaccctctctgttccttaacctcttctttaagtggaacatttcctcctttcctttgccacctgaaatatgctctaaacattcgaactgatgaattatattcttgtttgtgtccttccttcttcctctattttcatctcagccatttcttggcctctttgatctactgctacaaataagacattgtctctgaatgtttcattctggaaggtgcagctctatgctcttcacagtaagcaagggagagattctccactcatgcagtacctacaattgctctacgctttccccattgcatgaaccaactcttttctttctacagcatgactttcacttggttcacaaatactgcatgccttttggtgcttggcagagtgctaggcattgaacagagagtggtgatcgtggccttgccagcaagcactgatcttatttatttagtttatggacagtcaactctttcaaccatgctatggataaaagcagtttcaaaattatttttatctttttgattgcagatgtactcatcctgattaatcatacattaaaaattactttgcatttcttgcggtataaaattcaacaaccctatagtgtgctggagaactgactggctggtccattcaaatgtgttcatggaatatccacagggggccatacaatgtttgtcctatttttcttgcacacacatttctattgcttcctgtattagctatctttgtaggcatctggagggcaagggccaggtctatttgacgtgaattgtagggaaactaggtcagaggcacatcactcttttgtgaatgtgttatatattcaacagattattgatttactggatttaatggattttcttttctctgtgctttataaggaaagaagtaactgttaaatgaaacaaaataagcacaggctataaatgtttagccctaactgtgaggagggtttaaacatgggttgcttatcttctgtgtcttctgtccttattgattttcatattccaccctcagctcaagctatgcatttgatattgttgacttctagactgctactttggggcctgcctcccttgctgcgatgtggatggatgacacccattttttttctagttaagcagagtaactgataagttctgatgtcaagtttgtcgatgcttcacaaccagggaagtttttaactacattgtctgacagctgagtcatccagcctccaagcctttctatgatacatttttctttctaattcagaaactttgaaactatcccttcgccaactcaggggaatgtgtggggctttatgtttcattttagtgccttccttttttgtgtgtgatttggtgcagtaaattatctgaaaaacgactacccctttttataggagctttacaaatgacctactgagtaaatggcctagtccatgtctctgggccgatatagaaacagctttgggctctcagttcacccaaaatggtctggggagagaatctccttagatgaaaatgtattttaacttttttagtacaagcaggctttccaaaggtggcagaaagcatggaacttatcttaaagtactgagttggttttagatgtaattttaaaaacaagataatttgattgtttaaacacgacagtttttttttaaagtaatacgtcatagccaatcaaaattcccaagccagaaaaaaatgtttttttcaatttagccagtctgctttaaatctaggatatcccaggggcttggctaaactagccatgagattgctccccaaccccactgtcacctccagccttttaaatcaaaaagcataaaaatgtatggcagcaaagaaagatgctctgaggcagggactagccttgactcctaatatggtcagattgcaattaaccagaggatcagcagctctgttaggcattttaaatttctgtttaactcaaaagccttatttttgtttgaagcttcttggagttgagtcttgctttaaagtatgaatgcagaagtctgcctttgaaaacatggtgtggattactgaaaagatggtgtgaatgactgagaaccctggaggtcgtgggtatcagaaccaaccttgttgggggaaggactctttagcagtgtgatttgcaatttttcttctccaaaatatccctctttcatctactccccagacgcctgcagtggtgtctacattttcacctctgcaactcattcctttgattgaagcattgttgcccactccagaaaggttctcctaaaatacacagaacctaaaaggagcaataaatgaaatcgataagaccgtacagcaaagaagtcaatcagattgtctcctttctagatacaggaaggaaacgggcagtgactgtagctcattgggctttggggtatctgggagaagtccttaaaaggaagactggaacacaggaaaggaaagaacacaataaaactaatttcataatatttttaagaataagcctgttatgtccatggatcattagcttaaaccgtagagagaagactgtgatgtcagcttgtgtgtgtgtgtgtgtgtgtgtgtgtgtgcatgtgcacatgtgtgcactgggcaggggggcggtggggggtgggcacttttttcaaagtgcaatataacaaaaaatattattctttgaggcgctgtttgtgggattctagatagtttagattttaccacaaatctgtaagagaaagtaaggaatttgaagattgtgtcatataaataaaacaggatacactcaccatcaccctcccctaccaagcaaatccaaataaagcctagggttgggggaagaatgataaatcctcagtccccacccccaatatagttgtgatagatgtctgataatttcaaccggagtgtagggagaatggtgttctgtctctttacctctctcttaagaacagaattaggggatgtaaattgcaaaaaacctgagttaagagttctttctggccttacatggtggtgaaaattaaaaagggtcaaagacaatctcacgattagtgagaaagtacacccttcccaccccctgccatctaccaatcccatttacaaagacgccccatgtctttcaaaacagagcccgcaaattaccatgaaaatctgccccaacagactgtgctcaagtagaagtcagagcttttgttagcaggggtttgtgggggatggcaccatagcgaacacagttaagcctcactaattccctgaatgagggaaaggccaatcttgatttgtaagaagcttgaatttgaaaatatgtttaaagaaatgccatgttattatttctaaaaacctgcagtcaaactgctggctggggtctgtgctctgagctgcctagactctcaaggcctcaaacaaacagataaggactataattagcatattggtaatttgaatgcaaagtgcacttagagtggcgctttaaaaacgtgtgttagcgtactctcctagcaggctgtcacttttctatgtttatagtattaatttgcctagcaacttgccccctttcctttttggcagtaaactttagcctcacatgtcagaattcgttaaattttccatattagcagctggaatgaacaagtaagtgtgtgtgtgtgtgtgtgtgtgtgtgtgtgtgtgtggcagggtttgctgtgggagagaggtggtgaaccactttttaaaataattatgaacatattgtaaacttctattctgctgacctttaaaattcatcagttaattgatatttatttattgagtagggaatgtattctcttggatgattaaaaagggtaggaggggcaagctgtttcaaatgtccttcccctacaagtggtcgtatcaagtgaacatgagagaacattgactgtaagaagttcttgcattattacaaaaaaaaaaaaaggattgattatgaagtgcaacaggtgcttaattatatgaaacaacagcacactgagatctgcatctatcaaacacatcttccatggtcagccaatcctgtgtgcacatattaactttgtttgtaaattcacacttgagaccacttaatttgaagtgtgactgagttctgtttgggaggggaaaacagaagagaagattaatacagcttcagttttacccaaatattcaatatcttcatcattttgctgtggacgtggaagaaaaaggggatgttcattaccagaacgaaccatctggtaatcaggacagggactgcaaaaaaaaaaaaacaaaaaaaaaaaaaacagaagacaaaaagcaaacaaacaaaaaaacctgggtaaagcctccaagaagatcaaatttaatgccttctccttgagaaattccccccaccccaccccattccacttcctggccttcttcagacactcagagacatcagacactgagggagatcaggagagaataaccacaagcctgtggaagaaaaatagtccttaagtaatgaaatccctaatacagtggttcccaaattttgctgcacatcggaatctgagattagaacctgaggagattttttaaaaatcctagtgtccagattcatgctatccaattaagttagaatgtctaggggtaggggccaagcactagcattttataaaaatcaccaggtggttccttgtgcagccaaatcgagaaccactaccctaatgctttcccactttacatgcatttaatttatatttaaccttcccaattaccctaagaagaaggtgctgttggatccctcatttcacagatgaggaaactgaggttcagagggactaaatacgttgtccaaggttatcaaactataaaatagtgaacctgggatttgaaggccagcggtttaattacagagactgcatgctggacgtctatgtaataatgtccctcctggcttttgtccttgtatccagtaccattacactaaatttgatatagaacaatcccacatcaatgtggtgagagtttattagacatctgttatgtatatcatacccattttagtcacactgtgagcctctaggtagattctaggaaatatggctaacttctgatcattcaaggggttttctaggtaaccctggcttggttaccatttgttatggtaaagcttaattagccaaagactgtcagagacaagactatagtcccacaaactcaaatttattgtgtggtttaagaactgagtatctccagtaataaatacaagtagcaaagcaggtttaaggcatcactggtaagaaaggagtagtcactcaaagtaggcggtgtagttatggccttttacaactgccgtgtgaccttgggagaaagtgttttctattaactttgcagctggctttatctgtccattctcccagcctgattaatggcagggctgctttttcttagctcaaactgactttcactctttcagttctggggaagttttgactttttcaggttttggtccttttcagaaagggatgagcccgagaaaaatattgacattcagattaactattaataatgttgctcctcttcagccaagttggtaaaatagttaatggaaaaatgtatgtaaaaaccaggcaagtctgaataaagtcagtatttgagttagtagtcatatactaatgtcagtttccagggatttgtcaatgtactgcggctgtgcaaaataaaatcaatataatatatcaaaatattgggggaactcggtgaaagataatgggaactctctgtactatttttgtaactttgtgtaagtcttaaactacttcaaaataagaaagctataaaagatgtttaatgggagaacaggtttgtgttgattatctaaataagacttttctaaattagtctgactttaggcttttccatgaataacccaaaattggttgtaccagtgttctcttttatgcttctagatttgaatattgggtactgtagtgatatcagtggattagtcaacatccatatccaccaggtacagatccctttgggattagaaatataagaccagtttgttcatcaacaagatgccatttgagtagagtctggaaatatgtgttcaatatcattgggtagggaaaggagggagaaagttgtggtaggcagagggaagatcaggaggaaaggcacagagatatgaaagtcaaggcacatcaaggaaacagaggaagtttgatacggctgaccctcggggtataaggaaggagtggtgggaaaaaaccctggaaagatgagttacagctggagtgtgacaatctggatgtgattctcctctctgtgaaattaaagaatttagacttcttttgtagtacttactacatctgtcttgtgtcatagtttcctgggtgtatattttctcttcccaactagattccaagtttcttgaggagatgccccaagtttgactcacctatgtagcgtccgtagcacctagatgtgtgttttgcacttagtaggaactgaataagtctgtcctaggaatttctaatgtaccacaaagacgccactgatattccctctcaagaacatctggagccccacgagaatatagagtgaggtgtttacctccagggaaatgaaagtcgcaagcagaaaagcccacaaccaatctccctcaatctctcttcatgtagggctttggggactgggtttggccatgccctaccatctttgacacatagccctcttttccccggaccatgcccataatgaagccccttgaagagaggtaatgtgctttgccttagtcaatttggcattccactcacacctccctctatttagctttactggagggttgcagaggttcctcactccttcaccacctgttcctcatgtctctggattatagtggatacatgagttcaagagggacctggagagggtagatatggaactcttcaagattgtttccaggatttgcctgacataaattgtctgagaggatctccaccatttgccttttggtgatttattttctcttcgcctcctgagagaaatgttctattgctcaccatttcagatggttgggtgtggggatgggggcacttctgttcctgacaacctcattatgtggttatcaggagcagacactgcccaggttgtcacgacaaccagcaatgattcaaagcttccctgaaaggtctgtatctccggcaaataatcagcctttagctctcagcagatgctgaactgagcagccaatcacaggtgagctggaaaaacatgacatcatagtccagccggtccaaaaaaaataaaaataaataagatttggttttctctttacttccttcattctttatcccctagattttgttttctactttctccttctctttttccttcttagtaaaatggggagagcaatgaaaccaactttccaaattcaattcactctgcaggttggacttaggttccagtagtgcagtgattgagatcatgtaaggaaggaatatataatatgatccacttgggagaaaaatcaaacagagcatcagctcaattaaacaatgtggtttgatatgtaggaccatggtggaagcagggctaattaaaaccaagtcagaggagaggaactttctaattctcatattaattcacccagagccacctggatttaattgtcttctgcttttccttcactaactccctggtggaagggaacagggcaaaagctgggggcttcagaaagctcgtaggttctacagggcaggtctctaatgggggataattgtagtgaaagaaggtcaggagaaatccttcattcccaagctgccaccatttagggagcatatgtaaatgcgactcatcaagtctattaaggagatgtatagctcagaaatctgttaaatctgcttttgttccattagctgtttgtatccatacaacaatccaaggagagaggcaaggcgagttcgacaaaggagaaaactagtgcccagcgaaatttgagtcttgttcaggatttcctctccagaggctggaatagaacctgggtttcctgatttccaggaaagaactcgaagacccaagagaatggtaacttcccagccatgggctttcctctttccctcacctctgatttttcagagacctaggacaagacctcttggcatctctgatgctccttgctctttgcccagcaggtaacccacaatgctgcctgccacagaagagcttgagacccctatgatgggcatggggaggcaggaaggaaggggctccattgcaccagactgcagtaatggcaacgggttgtagtgagcggccctgagtgaaggaggagtaggcactgtgctcctagccaatgctgtgcaccagctgccaaaccccaggttcttttgtattcaaagagtggggacactttttttttagtgcagctgctgtagcaaaagatgtgaagactgagatccaaacagacccagagtccactactgggaacaacttctggctgtgggacttgaggcaggggtgggaagggagcaaggaaatctgggttgcttttgcccagtgggttattcattactgccttgcattcagtgcctgcccaggtatggctcagctcagtctggcacaccatagccttgattgctacacctgaatcattgacctggcattcagacctctttcaggatagcaggggtagtttgcttgcttttgtcttaaccaaaataagactgtatttcctatttccccttttaatgatgtttcttacaagtaaaatatagcatatgcttattgtaaaaacatacaaacaagacagtagtatataaagaaaagggttaatgtcccccatcatatacacatacccacatgtctttcctaccctcttttattcccagagtgtcccctttagcagttaaaacacacacatacacccaattttttaaacaaaaataaaatcataatacacgtgctgttctgcattttttcactcaagaatgggtcaaggagtattactatttcagtacagaggggtctatatacttggttttttaagctgatgcatagtagtccaaaatatgtatctaccataatttatttaatgattcacttacttgggcaggagaaaactttgggaggtgatagatatgtccatgccttggatggtggtgatagtttcacaggtgtatacttattcccaaactcatagagttgtatacattaaatatgtacaactttttacatggcaatcatatttgacaaagtggctaaaaaaacaacagttcccttactgagggacatttaggctacctttcatgtaatatttttcattcttatataatattcagcataacatatttcaacatttcttgacatgtttttatgaatatattcataatcagattccttgagttggaattgctgggtcaagtggcacatgcattttaacatttcctaagtactacccacttgtgctcccaaaaggttgtgccatttacactcccgtcaattgtatatgagagtgagcaatgttccttttatccaggatttgactgaaacagtttgaagatattcatttcagtttacttctgttattaaaagccccatcccagcgcttctcacttctcatgtgaatcaaggggctagttgggttggtaaagacccagagaagatatacaactcaagtggccatatagggtggcagaacaaacatagaactgagaattggagacctggtttccaggaccatctctgtgaagcactggacaggtaacttcaaacccctgagtctccattctctcatctatgaaatgcagatcataataattgccatagtaaactgttgtggttgttgtgaggatcagatggggagatacaaaagtggtttgtaacctgagaagtaggatacacatgccaagtggttatgatggtagtgttgtaatacccttaaatcaaagagctcccaagcaagagaacagtgagttgggtggtaaaaatggtgagttgaggggaaaaattacacagatgaaatctttaagatatttcagattggaatcccttcctgagatctcccatgcagttgccctatattcttggagaacaaaccatgttgacagtaaagactgctttctcgtatcaagaataacataggttatcaccctttcataggaagaccctaggcttgggtcttaagtccagtcctctttctatgacatcactatgctttgtcagtcacctaataggattttgtccacatgctactttctacaatcactagggagaaaggaaatacacccatgaaatgtttaaataaccatgtgtggtgactgcataaatagctctgagttatagctgaggtatatgggaggattagagtgaaatcaaataccttctcattacaagttaaatcaatagcctagaagacccaagttaaatcattagccaggaaaatccagttatatttttctatttcttaaaaaaggttcttgtttaacccaaataaatgcattttacaaatcagagatgttaacattgaataaattacattcattttgatttgtgatttttttagattatttttaccatggtgtagaaaaaaaccagtgggatgtggttgctttttttttttaactccaaagttagttaaaaagatatctgtaaaatcactggagtcagaaccatcctgattccaacttattaatgaaggatttgagaaagagtgttgtatatttttgcattaaagacaaccacgacaccaaaaaagctatttttaaaaatgcctgattttttaaaaatgccaatcttatatagtctgtttcttttaaagcaagtatgtattttaacaaaaccagtaataccacatttaattcttagcagtagtaaactgtatcatattagaaaaagcatggactttggactcatttcgatacaaatcccagctctaccactttctacaatgttaatgtaatactcatatatgcattaatatatatattttgaatttaggaaaataaaatgcaaactgacccttaaaaatggtctggattacatcgtttacttagtctttgcctccctctttcttgttttggcatagagtggatcattgttgttgtttttctcaattccctgtatcatcacaatttaaaatgaatcagtccaaaagaggcatcccattcttcaactgcctgagatgttttgtctggcgaatctgtagctctttttttttttttttttttttttttggagacggagttttgctcttgttgcccagactggagtgcagtggcgcaatctcggctcactgcaacctccacctcctgggttcaagtgattctcctgtctcagcctcccaagtagctgggattacaggcgcatgccaccatgcccagttaatttttgtatttttagtagagacggggtttcatcatattggtcagactggtcttgaactcctgacctcaggtgatccgcccgcctgggcttcccaaagtgctgggattacaggtgtgagccaccgcgtgtggtcatctgtagctcttttgtacgacttttactaaaaggacctgggcagatatattagttcactcttgttcttgaaacctattttgttggcattatggagaaattattgctggatgttacacagtgtggagaaaattgaataaaagttcactgggaagggtcatgatctattttggccatttaagtatgtgaggatatatttatctttatgaaaataaatttgaaagtagaaagaaaaagttactcataatactactagtttaacccaacggttacaattttatgtcctcttctgatcgttttctgtaggcatattttacatcattataatttgaatgtccttattgttttgtattatttgactttttatggcagcttactgtcgccttgctgggattcaccataatttacataatctagccaaatcatggggagtatggattttggagtagcaagagattatttttggagttagattttataaagctttggccatctgcaaaaatttgaaccgtatcctaaagacaagagaaagctttgaaggtttaagggaaaggatggacagagagaatcgcatttaagctccatttgaagtagagttatttttattttttgtataattccttgctttttggaatgtgtgtgcttcatatgcagaaaagtagtttcccgatctagactgccatctctttgaattccactgccacatctgtctctcttagttttctgtgtattttagagattccgtcagtttaacctgcctggctgacaggtggtgtcccaaatcgaaaccgttttttcccccgaataaagtgtgcccgtgtagctgtacagatttcgtcccctgaaaattcatctgaaatctcaattctcctgaggggagcaattaaggaagatacatgaactctcccctcctctccatcctgtcaggtgcccctcttttttgatggccccacctctgtctagacaaccctgacagtgtagaagtttccatctcctttccctttccctctccatgttccctccccttcagttttttccccctcccaggcgcttcctgcctggaaacaaaagattggtccccagtagcccactcagggcgattttagttttatgctcaccatctgattggcctaggtaaggtgcagagctcgggtgacgtaatagcagagaagggctagggagcggttgccgagcaggggctctaccgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcaggtaaatcccgcgactaactgcacccgggctaccgcgggggagggggtggctgttggatgatgctttaaggctgctgggcagatgttctgcctttccggacccccctcctgtcctgtttgtgccccagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctgtaagtcttccctttcacccccccgcccgcccccctacccagccccagtagctgtgacagcagttccctagaaaaggggagggggtgtggccacggtctggccaagtccggggtagaacccccccgccccttacacacacacacacacacacacacacacacacacacacacacgaggaaagagaaaaagtgacgattttcttaaacgggcgccttcccctctttcttttatttttctttatccccctcccctttttttggtggggggatggtaataacagggggacccttttcttctcctgtggggattggaatgatgcaataacgcccccagaaagctcagggtccctggattggccctctctttgtctggggagcagtgtcattgggtccactgcctctccttctctcctgttccccttagctcgctgggggacattgccctcagtttgtgaactggctctggcaagattactgccgcacttttgggtgaactgaacattttagattcttactctggcaagttttccttccctaggtggtggttaaggggtggggtggggtgggggatggtgggaagagggggatgcaggcaaggagagagatagaggccccacttgtttttttttttttttttggtcccacctttcagaatccagttccagattctagacttgagggttctgggctgttggtctgtagaagcgaaggagagaagggtgagtggcttggctttgggaagcatgatgggggcggttgcagtgctatttttaaaaaacggctttcagcagggaagcctttagccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtcagtgcggttttcactgggccatttgcaaaattataattgggcaagatctgtgatttggtacttgaggcctccaatcaggggcaactttgggcaaaaagacttgatatggtaatgaatgactaacaggcagaggcttggagagagagccatttgtaagcctctgtttctggatacaagtgtcatatcccccagcccatgcaagaagcaaaatgggaagagactaggaggtagcctgggcaagagctgacagctgagaatcctgaggtcagagagaccttaggatgtcaaggagctgaccctgcaagtctccggacaggcagctgggccttgtaggagagatctgacaggaaaaggaggttcacatgcaatagggttataagctaggggacacaggaccctagggacattctcaccagctaaccattcccacaggttgcagaatttcctggtcagaggtggaaatggtatatagggcaaacaagtttgctgaggtcttgggagagggtgagtggtggacataccaggtgagggaaacgagaaataaaaagaactgcagggatgggaaggtgctgacatccgagagtttgctattatgtgttcagagactaagctactaaattaaggttaaagaaggtggccaaggcaaaaaaaaaaaaaaaaatcaggtgtacagatcagatgtagtaggcaggaaggcaggagcaaactagagagagagagaagaaaagtcgtggccttaccaacaacccaaaagccctgaattctctggtgagataggcaactctggaggttgaggcagctgtagctcagccaagaattagaaggatgattctagatatttaaaatcaacagcatccccacccacgtaacccaccttcaggaaccagtagctttaaccaagagaacaagaaactcaatgagcagcagcctcaacaactggctctttcctcctgggtaaggagagggcagtggggaaggacggtgcctcaaagggaagtggaggcgctatcaatctggcctagacaggtaggttgactgcttttacatgggtgggctggggcctggtctgggacccctgctcaaaaaaaaaaaagaaaaaaagccctccttctcaggatccctggggaccctgtgtgcgcagggaactgtgtaaaacctttacttcggaaggtaagtgcagcgttctaggcatctggggcgtacttaagcctccgctacgcgtcccccacccccacccccacctgccgggggctaggcgtttccctctgcagggcctggaatggactcgtctgccaagtcggcactacacagcttctccagcagggggcggaaaagggcctgcagcgacgcgcaggacccgagtcctccatttcaggtgtgatgcttcagcctcggatcaaataatagccacacatttaaaatctcatttagggttaccggagaaccaaatgaacctccgggtgtggcagtctatttccatttcctcccagatatgcgtcgcttcctaccgcgctctgtggctttggaaggcatttgcatttacctacgcggtgattatttgagtcactaatacacacagcctaaccgggggtttaattggaaatgttaatcagtgcaatagatctgtgtctgatttccacatttggtcagttatctgcaggttggagcaatctgtgctaaacccaggggatgcaatgaggagcaaaacggtgcagctacagctgggtctaagtctgggaaacataatggggagatggaccttgaaaactggaaagagagtaacaatttactggtgggaagaggaaatcattagaaaggtgtagtcacagagaggcctgattgctgagatggaataggatggccttggaacccacatggtggagagggaggccagagtttttctttgaggttggagggggctgaatttggagagtgaagttttttaggggccaaaggaccaggaactggggtggaatgaaccctgggagtcagaagtcaagtgttatggagggctagggcctggtctgggacccccaaacacactgtcccagacagtgacagtctgggacccctgttgtgtttgggggtcccagacagtgtgtttgcccctctctaggcctcagtttccttgtctttcaaacgatgaacttggcactagttgttctataaggtggtccatttattcttggtaatgaagacaggtccactaaagtatagccctcttcttcccctgtcagaaaaattaccccttctttttttgtatgccctccagttttagggaaaacaatacaaaacaaccccacaaccacatatatttcatctctttcaacagtgtggctttacttttacttcatgtgaatggggaacaggagggaaaagagaagtccaagttaataatctgctagggaccctataaccaagcccctgaaaggttctgtgtggctgggtctcacagacctgagtggatgggtgggtggcgtatattcactagtggcccttactccctaactcaatctcaaaacagaaagtcttgggatgaaggtgaaggaagggcctggcttagggcgtatatccttctccttcgtgccctcctcccatatctcactgtgagccccaggcactttttggaattcagcaccctaaaagaaacactatccttaacaatcagcacaacagtgccctctagtgaccttaatggggacaattttaagagctccccatgcatccccggtcccagcctggtcaccagtgcccttgtgcagcggttactccttgtggagaaggctcccagtccttccaaccagcctgacagagaaactcagccagccaccgtttcctgcaagtccttctccttgcatatatggatggggctgggggttcacagagggagtcagctccccacaacttcctctccagcgttgtttcctttgggcctgaaaaaggttccaaacctcctttcctagacagcttcggtgctgagcaagatacttggcatgggaaggctctgtggtagacagagtagttgtccatagcttccacctacccccaccgccaaggtggcagccctagtccccagacagagattctgtcaggaagttggaatgcagcaaggtggctgggggtggagttgggttagtgatgggtattgggtatgtacaagatgtgtgcactgatttctacctcagtctccaacaggaggctgagccataggtgtacaacaaggcggtataggcatacaacatgatgtaggcacacaatgcccacaacactatacagacacacaacatggcataaagatatgacacaatacgaattagacacattgcacatacacaaaggatggaagagatgcaattcacatgcaacacagtacagacacatagcactcacacagtagcttattgacatgatcacgtatacaacatgatattaacaggacactgtacacacacacgatatgatgcagactcaatacatgcatgtcatggtagatatgacacagcacacatacacagacatacaacatggtacagggaactgtgcagatatacatgacccagtatgcacatgtgctcacacacaggatatctccccttgccctactctcaacacaacacacccccaggcaggtgagaggagtgtggctaccaggtggaatactgtgtcctgtcagttgattctgcactgactcaagcaagtggtgaaataaaggcaggttgccatggagttaaaaagtggtgctacaattgaggctggggggagggggaggtaagcttcaggaaagctcttgatcttgctctaaaacatggaggttcttggtagtacaggttgggggtgtgttctccttctcttacatcctctagtattgtttcccaccccagtgggtggatgctgcctctgctgtctgccctcatccccagagatgggcagggggcttcttgaggccattcttcctgtgtcctccttgagccccacccctctctggagctttggcagcttgcacccctctccccctcaccccaccctcttgcagggtgagctcacgtagggagggagggggcgagtacaccattcaatggtgcagtgggtgggatttggaaaggctgcctggagtgtgcatgtgggaagcacacatggaatgccagggatgctgggggacagacatgctctggagtcttgcccaagagcaagaggcagacccagagtatggcttggagttttaattccagaagggggaattggagatcatggggcttttcttggctccctaaggcttcaattttgcaatctccgtgtttagatatccatctagccatctctttggattaggaccctgttcattctggtctgtaataaataggtgctagcctgaatcatgcctccttgagaattagcatgtagtttctgcttttctttgaggacaaacaccactgtgggaaggggaaaggaaagcagagtaggaaggattgcagagcttggggttctacaaagagaagatcagcctctcccttgagaggctcaaatgattgtgggaaaaggcagaaagggaggggtcaaagagactcagtctccttcatggttagacatggaaacctctgtgggaaaaatagggtaaattatcaccaagcaacaacagtaaacagtatgtattcatcctaagaaacctggggagtactgtggaagacttacctggtggagacaggagaaggtagagggaagctccaattagggtcagaggctggggccttcagcacctgtgagatggtagcaaattaggagacctcagaatgctgttgcctggcagacagactttttttccacttctccagtgaaagaggttagtgaaaaggggaatggaaatggaggtggagacttagagttgagggatgaactgaactgaactgaatgcagtgccacaacatcaggaagctcacatattcacagagccaaccttcattggccattgtctctcagtttccttttgtccactggactctaccacctcctgtgattatacacattgctccataattatgcagactatgtaaatatttcacatctgtcctatttgatttagttcttccaacacttacccaagtcaactaaggcaggccttttcacttgatactaagcaggcccagaatgatgaggtgactaacagcaattctcagcttgtaactcccaactcctgactcccacttccgtgccctttctggaatcctatgtaacaatgcctttttacacttcttagccctctgattttctagctttcttaagagatattctgaaattcaccagagagattgagaaagagagagagagagtgtgtgtgtgtgtgtgtatgagagagagagtatgtgtgtgtgtgtgagagagagagagagagagagatgtttggtgggagttggatgagggagcagtagcaggtggggaaagaggttccctctcccctacaatgcttctctcagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggtgagtaatggagtccagggcagggagttagggatctccaaatccaggcaaatgctgcttttccaccagatctcccaatatcaaagactctgcctagacctcgtgagctaggcctcagggcatgacccctatgttctggggaattttgcccagtacagctgcctttagtctcttgcctccctcccatctctaatatgggaatgacagccttgacctacattttggggtgaggaggagaaacaacataacaatcgttgccaagtccgttgcagatgtcaagcaccatctaagagcttcagtataacacagacatgcttcccatcaagctgtcattttcttttctcctcctttcctggtgcctgggtggcttttcagccacatgctgcaaatttgccattcagttcctatgatttctactgccccataaccttaattttaccttcctgtttgaagtgtacccccaccccttccatccctgcttctgggcctgtcagacttagcttaaaccttcccaaaccttccctctgctttcccacccaaccaagatgcacttcctccaccaggtctccaacagcacttgagtctgtagcgtgcagggtagcacttgctgccctactgccttaaataagtcttgcatggtttctggagtattcatcttaccaggaaaactagattgtaagctcttcaagggcagggactagatcttacagatctctagtctcccttaaaagggctcaaaagttccccagcagctttgcaagttgggcctctctctcttcctctgcatttctttcaggtttcatggcctgtctctccgatcatctatttgtttttttgtctgcctttcaggcaggcattataacttcttctgtcagcttctccatctggcctctgttgctattccctgcagtccagctacctgcttgtagcttgctgtccctctgtctggtcttctgtctatcagttgcttaggcatctctcctattacccaaatcaaaaaacaaccaacaaaattaaaaaaaaaaaacagaaaaactaaacaaaaaacaagcaaggaataagcaatgtagttccctttcacactgagcatacaatgcgcctacagacaaggtaaaactgcagctcagcagcaggtgtttctgtgatgccttcttatgaaagggaagctccagagtttcagccatggaattgaaggtatgaaattacagccttgttgatactgatgcattcaactttctagcgatgttctggtaggggatcctctttaggccttgacggacagaaggtaactaggactgactaaaatgagaagcccctgaatcgctctttggtgttctgtgacagatgcaataataacttgtatttattgtctactgttgccagctctgtgctaggctctttactggcatgataccattttctcctatgataatcttgcaaggtaggtatttttttttctaatagttattgctgtttctgattatacaagtgatactagctgaagttaggtattatcatcattactgttttaccaaggaggagatagaggctgagagaagctaagtaacttgcctgtaacagaagacatgctgtggctttgggaagaaagagacttcctggagagagtttcccagcatccaaagttattttggtatctttagttcatgcacatacacatacatactctcacaagcacattcttgtactcttgtacattcacacagtcacatcatcccctgggctcactcacttttcatactggagtcattcaaaatgatgatcactcttatgccctcaccctcacacacaatcatatttacatacatgctacatttaggtacattcacactgccacaaattcacattcacgtattcacattttcatattgatgcacacaacacacttaccatacaccccaccctcatgttcacagacactcacacctttgtgctattaatatcatattctcacacacacacacaatcatacactttcacacttacattcacacagaggatacaatcacctttgcctgcccaaattcctgtatagtcatacatactctatacacaaataatacattgacattccccctgcacacactccaactgtttcttatactcacagccattcatacactcaatttcatacactccagtgtacttgcattgatgtcatcactgtttcttcctcacagtcacaaacttatcacagggacacaaacgtgcatacatgctcatatatccacgtttatattttctcacatcataagcaccatctcacccacttgcacttttacacttagaattacacacttttgcattcacatacacagagctaaaacaacctccctactcctgatacattcacacataatcacattcatacatagaaacacacattttgccacacattcacactcacacactcactttcttcacactgagacatcatcacactctataccaaacttgcaggcacatacactgaaatacaaccatacacacatatttttataaactcagccattttcactgaaaaccgtcactctaccctctcaaactcaagcacaatcacttacacacacaggtatagtcacattgactgacacatatataggcttattcacattcagtactcatacaaattcacataaacatacatactgcacatgtacttaacactcacatattcactcactttcacattcacgactgtacactcaaaattatacacgcccttattcccacagacaagcactcctccacattcgtgtacatgcacatgtgtaccccctcacacaccatcccccactcgtacatcacacattttcacactggcccaatcacacttaccacacactcacattcttatacattcccactcttctactttcatactgacacacccttactcacttcgctacacacgtttgcaccagtgcacatataatgacatgcacagtcactgacttgcattcatgctagcacataccacactgacatacacaattcacattgcaatagttgactgtgcttcacacaggcaattactgataccacatatgacaacatagactcacactcacaatcgccatgccacattctcacttacattgatacacttacactgacacacctgttcaggaagtcaaacactctcccgtaatccaccatgtactcttactcagactctcacatgaacacgttgacacttaactaccactgagataatcacattgacccacatctattcacattgattcacacatactgctagtgacccacactctcactcatacatactttcccaaactcttacacatccccctcccatcccaatagccctgcatttatatactttctcactgacacacacacacggatacatctaattgcaagaaatagtttatattcacagttgtctcttttttctttgtttgccactagtgctctcctcacccctgctgaaaggttatattggcaaccagttgccagaggaaaaatgttggtctcatccaggaggtcaatgagaaatagatcctttcagagcagaaaggagtagaatttatgtctaggattaaaaaagaaaaggctcaaacccacagatcaagttttccttatcctttccacatactttttcttttttcagaaatcatctccaatacagccttagccagtcctgtccaacacaggttggagtttagatggtgtgtttattttctggaagtttatggcttaacttgctacctcatttctttcctatagtgaaaggaagatgaaggatgtgtttctttatgtgctgttaatggtttcttatgcaaaagtgcatgtctctggttttatatttatgatctggaattgcctgctgattacacacatggaaagggcaggcctgcttccaccaggcacctctaatctagccaggtatacttaataccctgttaaccctggaacatggcactcaaggaaaggaaagagaaggttaatgaactagctggatgataaggtaaatttgtactgtaagtgttcatgtgcgatagtagaccccactgaaatttcaacagctgttactaacaagttacaagaggagatttttcagtaggcgtggataaagacaagctgaaggaagtttcttgcacttcagaaagactgtagatttccctgcaagtggataaaaagaagcacaaacccaggagtgaactaatggatcaggagcctggtgcaagagtcatgtgccaacagagatttgaaaacacaagagcatcttgcaagggtgtctctagtacatggcttctcctgctggagtcaccctggagcaaaaaatgagttcagaatatacccaagctgccatttggtatgggttctagcatgccttagggaagagcttattctctggaatataacccaactccctgccattagattgagaacttctttgatagcaagaactatattatcttactcattttggtttcttgatgcctagtgcaatgctaggtccagaaaagctacttgtgagactcagttaagaaactaaaggggatacctgagcaggaacatcttatcaatacagacccagtgtctctcttcttctcttcctcaatcccagatttgcagtggcattaccagctcagattgaggattgtctgtaggccccacatagagctaggcccagagattcaaatgggtgaaagacacacctattgcactctaaggtactttcatttgtgtgggaaagatcaagttgccatgaaacagtagtatgaggcaacagtctggaagcttgggcatggagggatctttatcatgaaatccagtggtctgtaggctccaaaggtcttgacggttcataagtagttggggacagcagtcagaatttagagaagtcactttccaaagtaaacttccttgtagatagcttgcttagcacagggctgtgccatattcccagaagattgtataacagagtactctgttactgggcctaaagtggagtaataagagtgatctgcagaccttagtgagattattgtacttattaagatctaaccaccacctcctccaagagacagcttaagacaggggttcccaaactctggactgcagaccagtgctggtccacagtctgttaggaactgggcagcacagcaggaggtgagtggtggatgacaagcattacttcctgagctccacttcctgtcagatcagcagcaacattagattcttatgggagcgtgagccctattgtgaactgcacaggcaagggatctaggttgtgtgctccttatgagaatctgatgcctgatgatctgagatggaacagtttcattccaaaaccaccccattgccccatgtccatggaaaaattgtcttccacaaaactggtacctgatgccaaaaaaggttgaggactgctggcttaagagaaacagctgggcaattttacatttggaaatttttggccattacttcaagattcaccaaaggcaatttatataatttgcaggactggctgaatattaggaagagaaaaatgcacctgcctgagtgtgcttgaattcagtgagaagcactgagaaaacccattcccaaacccatcatgcatttatatgatattttatacttttaaaaatgtttaataacccattcttccatttcaatagaggtgttaggagcaccaactctggtatcagccagaccaccatttgaatcccagtttggccacttcctagctgtgtaaccttgtttgagaaattatccccattgcttcttaggccttttggctaagatcaagtgaagagaaattacttatcccccttaagcctcagtgtccttatgtgtaaaatgggaatgacactaatgtcatctacctcatggagttgttaagaggatgaaatgagataatatatgaaagtgtttagcaaaatgtctggcttatagtaaatgtttgacacagtatagagcttattatctttaccatagccctttgaggtaggcaccttcaaagggacagatccttgacataacagagaaacagtatggttctttgcagccaaagattgattttcacaggacttgttgcctgttttcctttaagtctttatttctgcctagccacaagctaggtgtcagtattcattcccactcaagacgatgagtgaaaaataggattagtccatggagtttcctcaactactgtgtctctttaggacatgtttatcttgcagaaatgtgtcctgttcatttagctatcccctctagtcctacttccacccttgaaatcagtaaagccatcagtgatgccacctttatttgccagtacccaaacttgtgggggtggtgagtagaagagattcctaatgtaggtggaaccagcaattggttctcttaccataggcattcttctgtccttgattctgattgttgaaatgtctgttttgtgggtggaagatctgctcattttcaggctttcgtcccaaacgccacagtggaagcacagtttacttacgacaaagccctaagaacattcatgttcatgtaaaagctgtgagtaactgcagaatttaatatgaaactttccgtgacttaggaaacagaaataagtgcacgggcattgatgtcacatagacatgggatggtataatcttactattacatttactagttctgtgaccttggtcaagtgacttaatgaatgtgcttcttcatatgtggaatgaaaatactgtaataacacctcaggggttatgcaagttatgtgaacttgtacctaagtaacttttagcagagtgcgtgggccatgataagatttcagtgaatgatagcgattttgtttatggcttgtgaaatctgtgaaaataaactgtaaacatctattggtagaatgtcttgaattacttcaaagcagttcccaaatgtggatatgtgatcctcacaatctactggtgacgtgatcaccctttctagatgaagaaatagcttcagaggggtgaagagatgtacctaatgtcacgcagcttgtgagtggcagtactaggcttagaaagcaccagttcagatgattgaatatttgcaccttcacttggtaaagcctttgggggctacagttagcaaataagaacaatttgaactgagcataatccttcttgtgacaaaaatatctaaatgtgagctacagtttatctacaaatcgaaccataggtgtttctctttgtatcttgtgcaatgcccagaatgttgcaagagtgaaacaaatgtgacatcataaatgtttggaaagcagtacctttccaaacatagctgagtgacatagggccacagtagtaccattcaccaccaagaggaaaatctttcttgaggcataaatactgtgtggttctgctcatgttgctccagtaacaccaaatgttcagagtctgggaattcttaaaacatacggagacacttcaacagacctgtggtgccacttggccatttctgtcctgacatgagaattataagacatcaagcttagtaaacgttagggagaggatgggaggacaaaaagataggagcacttttggcctttttgtaacatttttctcatagccaaacattcaccttgaagcactcttctcttggtttctatgacaacatatcagttctcccgcctctttgaccatctttctcagggatcattagtcactcttcctcttccaacctctaaatgttggtgttccacagagatctggtctagtcctccttctcattgtgtattcttcctgagcaattgtgcatattcccatgctgatggcctccaaacaaatatcttcatcccacatgtccagctctccattgaacagtttcataatgccaaatgaatgtgttagaaccactgctacaattgtatctgtcttaatattgctatctctgttatgaggaatagatatagctagagatacagtttttccaccacatgtgaattgatgtttccttcaattattttattacttgccatgtagattatacttttcaaagacaagatgcttagatatgtgtcttgcttcccactagatatttctagttaagtttttactgatatttctattgtgtcactggttttatcctcttatctttgcctgttgtagtcttgatagtattattatgtttgttggtaaagtctggataaaaatttagatgaattttctataaaacttattataagtgccgttctattggccaaaaatattataataatttgttcttattctctttagagtgcaattattacaggtggtctaatggttgctaatacaagggacttccaacacattcatatttgttatcagcacactaacttcattagttatttttcatctccattctaagctattcggttattttcatttcacaaacatggaaactgaggcacggttctatttggaatcccaaatgtaaactaaagcttgcaaaaaccattaggccattaggcctcccatactcctctgggcctcttggcatagaaatatatctctaccctgatttccatttggggtcctgagaacagttaatcctatcaaggctggcatctctaccatctttggccaatgtccactgtagagacctctcttgacatctctcttctcctgtcttcctattcccatgctgcatgtgctttctgtctcttgactgattatcttagtgttgtcacttttcaaaatgatttccatgttcctacctggaacatctgactccataggaaaaacctttcccaagtcttcaaccttagacatctgctacattgtcacctgagtaatagttctgaaattcaaagttaatcatgctatctcaccacttgaaacctcttcatatacacaagaggagtccaaaccttgtagaaacgcatattaaacccttcttaattcgtctctatggatcttatttttttccattcctcttttttgtccctaatctccttaatacacgttgctgcttgacctgaaaaatggtgtggttaattgttcttcctaattcaactcgactgtacttcccctgtgaagcctgcttcgtcaggctccagggagtctctgtctctgtccttctatagcaaccttttctcatctttgcactgagatgtcatggctgacatccattatattttaagtctcttcaagggcggggtcaactttgttcatctctcaccctagaacctggtgaactcctactttcctttaataccctgttcaagtgctatatcctctgaaccctccaggcaccattagctacccttcttccactgtcctttcaaagcatccaatgcctaccttagcacataatagacaccatataaatgatgaataaatgaataaatttaagaaggtttaatgatttcttcaggatcacagaaaaatccagaagtagagctagagttagtcattcattccttctgttagaaacaattcttttgggtttataaaaaatctactaaataaaaatcaaccccccaaattaagtctgcctaacaacatgcaacttagttcttaaatgtaacatcgaaggtaagtttctttttccgagtgttatgtgcctaataaatttccccaaagagatctgtcctgcttatatatggatacagttctaaaaatgcttttaggtcttacacatattattttcttccagagttttgagatctattcttttacttatacagcaccaatatcattcagtccagcagaaacaggcccaaggctaataaatctaatctagcatgcttgaagtattcattggttgaaatatactgttgaataataataccttatgccaacctagtgcttcctacctttcaaatcctattgaattcctgctcatccttccataccctgctcaagcgctatatcctctgaacccgctgggaatattagctatccttcctgctctgtccctccaaagcatcttgtgcctacctagattgtatcacactgtattcttattgtatatatgcatgtctgccttcctcactagactagaagctctttgaagatagagatgtgtctttattcttctctctttgtatgcttcctgtacctgacataatacctagtatatatgaatgttggtggtgggaggatgtaaggccaggcagctatgttccctggaacaatatcaaacacattccttgtgtgtggtagtatgatttcttatatagcaataagatgaagagagtcttgcccttttctgaagtgctgtagctcctctttttaaatttttactctcattttgcaatgcacatatccttacttgttttgtagttctatttttgtctgtatatgacatactttttttaaattatactttaagttctagggtacatgtgcacaacatgcaggtttgtcacatatgtatacatgtgccatgttggtgtgctgcacccattaactcgtcatttacattaggtatatctcctaatgctatccctctcccctccccacttcccccaccccacgacaggctccagtgtgtgatgttccccaccctgtgtccaagtgttctcattgctcagttccaacctatgagtgagaacatgcggtgtttggttttctgtccttgcaatagattgctcagaatgatggtttccagcttcatctgtgtccctacagaggacatgaactcatccttttttatggctgcatagtattccatggtgtatatgtgccacatttttcttaatccagtctatcattgatggacatttgggttggttccaagtctttgctattatgaatagtgctgcaataaacatacgtgttcatgtgtctttataacagcatgatttataatcctttgggtatatacccagtaatgggatggctgggtcaaatggtatttctagttctagatccttgaggaattgccacactgtatgacatacattttacatataatgtgtggccaggaatgaaacccactgctggagcctataacctcactcagagctagacacttatttatctgcttacacccatcacttagtatgatgcctagcacataggcactggtaaatatttgtggttcaagtaaatgaattcatgcacagatgggttacttaaggggcctcaataatatattctcagttactatctgtcacctcaaagagtagtacctctctgttttgggctcaggattttttgaaatgaaagtcaaccagaaatgaacaaggataaagcattagttggtatattttcctgtaaaaaggaatgttgggctgacataagatcttttcctctctttatgcagctgtgtgacctatagaccttcattattaagctgtgcagaagagtatagggcatgcctaggtgatctgctaaaggccacaaaaccaactggtgattgactggcataattgggagtactatgacgtagaggatttgtcaggctcaatcttgaagaaaaaagaacactctaagatgagcatcatttgatacagagttatatacatttattatgaacacccgagtttcctcccctttctctctgcccagtgcctttgtcagaatgtgctctaggctacactgcagtctccgcaggaatgagtcaagaactactgactgatttaccctcaggcctgctgattacagctccttccaccaagccctgcttctgttttatctgcagttttcctcccaaaataccctaacttccttcttgtgtggtaagggctgggccctgtgatctcagcttgggggcttcccaggcccacagaaagacttaggcacacagcagtctttgctttgtatgtatatgagcactagggaagtaaagctgatcttgtgctgtggtagacatctactctagcatgaactaaagatgaaccatatattctataagtggacagcagcagctgcaaccaggtagtaaaataataagcattgagccacttgcaaattatgaacttgtataagctgggcatggaaaggccatgggaaaaccaacatactcaatcatgagttcgtccttcagatcaggcttttaatttctaaagagactgctttgggtgtattataatcttttttaaaatacccatgccagttttctttaatgcaaaacatttgtctggtgggcttgaatatggggaattcctacaagtaaggcccttgtcagctaaatgtttatcccccaccattgtgaagtgggatgggtagaaagtaggttttgtcatgtttcattcttccttcagtatttaagaaagcctgtttttaatagatgttatttcctcttccttaaccatagctcccaaatgagatgtttaaatgcatgctcagtataataataatgaaattaaaaaaagtatgggcatgtaaacataggtcaaggggcaaaaacttgaggaagtgttgctgcattttacaccagttcaaattctttaacttccatttctggcaagaagtcacttttttggtgaactgtgagatttgctaaattgatctaagttcctagtttagaaataacaccaaatctccattgccccaggtagctcttctcttcagatgtgaaatggacaccttccctgtagaaagctgatttgggtacagagaaattgggaatagagcaaggacctaggatgatgagccatgatgcacagtttgaaaagcaacattcaggcacctctgtggtatgcaaaaatctctaggaaattcaggaattgaatttccaagcttaaatttgaggacatttgttgatatttcactggggtggatcaataaagagtataattattatccatgcatagtaacagagacaatcgagacccccagagactcaagacattggtttgccatgtcctgcttgcttgggatgttaatctatctaatttgttccatctgaatgcttccaaggatgttatgtgctctgagaactaggaaatgttttcttactaagttttgcttctcttttcttttttccaccaatttctctgaggcatctcttagggtaattacttttgttttttatgcttaaaatatttctacctctattctttatggatcttattttctctttttagaagcatcaatattggaaacaaaaagctgaaacctgtaataatgcatcggtttgcaaatataagtacatgtaagataatcattagcattttctgggcattagctcatgaagcacacacaatgaataataaagtatggtgctgcatatgtttagaggcttaagaagtcatttgaaaaataactatacttaagaaaaagaatgattttttccttatatgcagtatatggagtctggatgctggattatacctattgacttcctatttgcaacctgacgttgaaatttgcaactataatatgctggcttcttggactcaattaatgtcaagttcctgctgaaaacaatggaagtcactcataaaaatgttagcagacaacaatactacagcagaactgacctcatttgcttgtttgtatgagagagaacatgaatgtatgctgtgtgagtgtgcttgtatgtatgtcagcagtgagctatctcttacatgatctaagattgaaactaggtggctgtaaaaagagctagtgcctctctttcttgtctggctgcttttgcagatctcctgcctaacaagtagctcagctccttctgatcaaatgatcttagaattggcttccctccattacacactgtaatggtatctccctagtgaggctctctgaaacagcacacccctgtctctgatagcagagttcccttggtgagtgctccagaagaggcgagctccaaaacgaggccatctaagaattggtacaactggccaacgaaacttgttggagtgttgtcagtaaatcacctagccttgtgtctttaaatgggaaaagccatttgaaataagtaagtaccagcatgaagtgggttgaaatgaatagggtagacctgtcgtatgaatattttaagaggataaaaatgtatatatgaagagtgtgtttgtgggtttacttggatatgcgttgtattggtgtactggaaagggaactgatgagtttaggagctgagggattggatactattctcagttttttcatttgtgaccttgggcaagtacttaaactcaaagcttgtaaattcctcatgtaagaaatggagatgatactttcttcttcgcaatgttgatgtcaggctcaaagaagagcaagacgtggaagccctttggacattacaaagtcatatgtttttaaaatgaggtgttggtaatcagatggtagctggctttgaaatgatgcctaactacttggcagttagactagtgctgatatttccaaatatgctttcttgtctctgacctgctacaattaggtctataggcttatgtaacattatgaaaaacttactccaagctgtaacaaatacataggatgtatagagttccattttgttactttacacatgtatttaatgcctgttggtaacaagagactgtactagtagtatgaaagtgtataattacgactgaggggctcttaccctcatggaacttatgatctaatgaggggagtgacttggataatgactgtgcaatttgagacaagatgatacaaatggtaatttgggcccatctagctggctatagttagtggttgggctgccccttttccacctagtttgggaatggtagtgtgggttcagagctgctaggagacccagatctggttcattcttctccctgtaaaatgcccgctttggcatcttagtatattatgggcattaatgtctgaaaagtcactagaaatcttcagatgctagttgctgtagaaatgcaaggcaacgtataatatttctttcaaatcctaagacattgtctcctttgtggaaggctagatgattttttctttttttggcagttaaaaatgttcactacatcttcttacattatcagtcataagtgaggtggttggttcttttgtaaataacgcatctaagataaagtggatttagtatcagcataggctagttagcaaagcatggtttgtttcccagtcaagtctatgcctgaaagctcagctagccatctcgaaaatgtatgcctttggttaaaagagagcccaagaaagagccagcagttgtaactcttggattttgttgcccaccaccaaaagtacaattcagatatatatatatatgtatatatatctcagattaggaaattcaccttggaaatttctcttagtgaacagctcagtcctgtgtttgatcctctcatttgctatgaaaagggcgttaaacagccttggtgtgtgctcagatttgtgataatagccttgtgtggctggtggttttggagattttcttctgggtttgttagatcatgactgtacattgctaacctggggttttgtttttaaaaggatggcagtgttaatttagttttcattggaaaaatataaaaataaatagttatgtctaaatatgaaatagttatgtctaaatatgaaaataaatagttatgtctattttgaaagcagacagaataatacagacattattattctacagtttgcaggaccatctattaagccatgagcaattgaaataaatatttttatcagatatcataccatcagagaaatagggctttactgcaaagcattttagagaaaaaactattaccaagatgcatggcaactatagattaataaagctctgtgtcaaggcaagttaatgaaggtcactctgtatgtgttcttgtgtgcccctgtgtgtacatgccttcaaacttgtgtggggagtggggagaaagggagagagaaagacagggaaagagagaggtaatctctcctagtactctgaagaaaaggggtatttaggctctttgcctatcatgaaacaagaggcttatgtcttattgctgatgaattgcaagtgtaattacagagcattgctaaaccacattaagtcccaagggctgaataaaaaaatatacaccatctacaaaagccatttaaattatctctgaaaaacctagtagtcaagtatgaaatcagtctgtgagcagatataaaccattgctggttatccattaaaattagctccacaatgctaagggccagtctctaaaagaaaaatgaatggcctgtggctatatctaatgtgctactcacaagtttctgtactgttacagaaatgaacaacaacagttgaactttaaagataaacagttttttttatcggattcctagagaataatggtgcttatgtacaattcttgaaatagagcctacagccgcccaaaataaaatagtctctttcaagatcttggaaataatgacatcataggcagattgaaccagcaatccattaatagtatcctttatagaaagctgtctcaggggaacacatggctaagtagattggcattgtttataaacataacataataaaatccctttttaaatatgtttgtggaatagtaggagatacttcccacttgggaaacaaatactttaaccacaaggattccttgcaggtccctaccctttctccattggtcttctaaaagtgtgcttagaggcacttgatttgaaggtgagttaaaataccaaggacctcctgtactattctttcaacagcaaagcagaattatctggaatcattagcagaggatgattggttgtgccttgtaatgggtagtaaagaaccaaagtaatatcaagataattaaaacaaaaccatatctgaactgtctaggaaaatggtttggttcaagctttattaagttcctagtgtggacctggacataggttcttcagtttcacttgtgtctttgtaaaaggtgtattccagctcctcttatgatgccttgattagttgaatgacattgaaacacttccagtttggtgggcaataggaatgtatgtcacataagctgagtcctttgcagaatgtctgtgatactgaccatggcaaatgtgtgttattgaatttttggtcagggatttttagtgcaatatagaagagtttagtttgagttttagatcccaagtattcctttcttcccaacccatattatacttggtcaaataaagtcagggtaatcaggcagcctgaaaggaagcagggcatctacctgcctctctggtcagatggagtaattaggaacaaaaaaggccactctgttgttagccacacctatttatcaagaacaaaggagcatagcattttaaattcatttgagctgaaaccctggctggctcagactcttacttgtcttatcacgcaagatcagctttgtatatcattttaaagaggtcgtgtggcgtgttttcctgacttctgtcatctcaagttaaatatgtcatcagaaaatatatatcatccagaaaatggtggctctctcttcctgtgagacactctttttagaaatttgtcttctaggtatttctattttaaaatgttcagtttctctgcaataactttcaaatttcattatttttaccaagctagattttgtatatctgtatacatatttatgtaataatcacttcatatttgcacatagtttttgaacccagaaaagtaaaagagaaaactagtgacttgtctctggtggcaaattttctctgtgactaaattaaaaccatgaacctgtccagtacagaataatgccactggtgaagtcagtcttaaattcactttaattctagagaaactgtgaatttagaaggaccaaaagtcaaaatgcaaaagataatgcagacacattagcactggtctcatattccagttcaaatatttactctagtaccgatagtatctctgaatatactttatccttgacatcacaattactttttcattgtaccttgttctgtagtttgacctaaataggaaaatgtaaggtttatgaaattgttggtgatagtgacaaaccatttattacttagtattttcactatcattattactgaaaaaatatagaattggtcttaattcattaagataatgcaagacatgacacttagcaaaacaaaagcgatctcccgttcaaatcaaaatcaaaccaattgttagttgtcaatcacctgtgcagatggagaagctattaattgatagtaacctattcttgagtaattacagactgtatatgtttgagagaatttagaacaaaataaaatttttaaaattctctacctaacatgatgtaacttagagtgcattactgagagtaataaacatactataaccactaaagggccggaaagcattgatagataatttttcagcacaacagttaatgagtagacccctgtttttgtttttattgttcttaggtttgttcatagtaaatgttgtggaaacaaagtgataatgctaagtcatgtttggagagttgtaatgttcctaaattagtaccaggtaatacttgataagtttacagagatatagttttaaagggatttgattttccttgaattcaaactggggattcatttggaaggtactattagtacctgacttgtgctggggtcaggaccttatggaaggacttgaattagagtaggaaaatacctggagacagaaacattcccttggggagttcatgcttttccagtttactttatcctcccaggggaatgaaaaccaaatatactcagatgtagacacaagatactaaagaataatgaacttggccaggcgcagtggctcatgcctgtaatcccagcactttgggaggccgaggcaggtggatcatgaggtcaggagatcaagaccattctggctaacacagtgaaaccccgtctctactaaaaatacaaaaaaaattagctgggcgtggtggtgggtgcctgtagtcccagctactagggaggctgaggcaggagaatggcatgaacctgggaggtggagcttgcagtgagccgagattgcgccactgcactccagcctgggccacagggtgagactccatctgaaaaaaaaaaaaaaaaaaaaaaaaagaataatgaaattcagagcaaataagctcctaaaacccagactggatcttacagctagctacctctgtcacctccctttttccttcttccaagacgtaaaatgtggcagggagtaaggttatggtgtctcctcgggaactggccctccaacatttgcccacctttatcttctgcctgcttgggagaatatggaacattgtttaccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgtcaattccaaactctgaggaggctgatcacctgaccactacaatcatcaggatagaattttaaaataagattgtaaattgttcactaaaacactgttagtggggaggagaaaatagagtttcaatgtgggaaaagcaaagggacttacatatttttataatatttgaaaagccattaattactgccttcactttccttttttgaaaattgcatcagggtttttgggaggtaacttccttccctccagaagagaaacccctaaaaacgatcctcacacaaaacctgagaaaacatgagagcaatgcttttgtttctaagatgttagaatccacatatttattaggtttttagacctcttctccctcaactccttttttttccctccttttctttaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaaatttgggtataggtaggtttacttctgtatacctttttgataactgaaaattttgaattcagtatatgagaatcagtccacgttgccacaatattgtctctctgactatattgtaagtgggaaggcatttctgagtcatttgtttccattatcattcttcaacctgttttcccctagacagccccatgtgtactgagtagcacaccaatatattataatttatccttctggtgtttgtaataccatttggtgcttaaatgtcatatgctaatgctttgtgacgtgcagggatatgaaatctctagtaagtaactttcaggttacattaattagcataaagctgaaacatggcttctacagatatgaagcaagtacaagggcactgacaccatagaaacttgtcagaagggcaagaagggtgatgtctttagaagagaaacaggacattctcaatctacttcttcaaggtaaaataaatagctttgtaggtcacttatatagtgttaatcaatctacaattcataccacaaagaaagctgaaactattagtatggccagtactgccacttgtacacctgcataacttaaaagatgctttgttcttcatgacccaaggatggaaaagatggaaatgaagttaaatctctggattgaagataaactgaagaataatgaaccacattccatgcaagagatttgtgactatgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaaataccttgaattcaaagtcctgctgattcttcagtctatttggtgcttcaggtacatttgccaatatgcatcctcatggtaaggttgtctttataactagccacatgtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgtctccagaggttattatcataagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaaatttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgtgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgataacagtatgcagtctttctttggtgatactggagaccctttggatcttgcagtagctcaaagttattatcactgcaccaataatgtgtaagagtgtcaattaattcagggttctgttatcagaaagccaggtatcagagactgctacatcctgaatggtgcttacattcttggttctgcaaatgtagcccatccagcttagcaaagagtgttctttggaaatcactgccctgcccttttggaaacctgaaggacatggcatcttgcttgtcctctagggtcagtgctatgccccaatagaagagtctcttgtactactcctttactcctaggaaacccgtgttgaaatgggaagaaggtggaataaggacacactctccctatctaccagggtctgtgcttccactttaaggccaatgaatggggaaactgggcacaaatatggtagccccgtaaaaccaacagacagtcaaatgcaagagaagtatggaatgtagggttgggagatgtttacactaaggtaaagaagccacagggagaaataaactgagaggaagtaatgactgaaagggagattaggaggtggagaagatacagaggatggatggaataagaggggaagacagaagagtgctgtatcaaacacgcagtttgatatgctttaaaaaatggagtgttgcaagaagaggaaaattgacaaaggctaagggatatgaagttgctttccccattaaggcaaatgaggcctcctttttctcctcagacttttaccctatataattatccacatgatcagaagtgtctagttaggacattgcctcatctttgctttttgttttcaaatgtttcccatcaaagttgttgcatatgtcaattgaatgcaaatgaaagtggaaccagtatgtgttgcctagagggagatgagtaagaggtaacttcctaatgatttcccagaataatcactgttgctgaatgtttttgaagatgataccactgaaggtgctagctgtttgcatgtgtgagtgggggtgacttgaagggctcacatgtgactatcattttacttcccccatcccatcatcctcacggaacatctgacctgtgaattgggcttgtggtcactcttgcagaatcaggtaccacattgagttttatctgtacattaaagcctgctaatttgtggaggacatatgttgttttccatagccactgaagacctagcaggagaaactgggcttaatattccaccagagagaatggaactagacataaattccagataggctaattggatgctataggttactaagagtgacattttctagaatcttcattagatatctcatggctttagcaagttctacatgaaggcaggagaatggaccttccaccatgggccttcccaactatatgcttttgagatttgctaatataataaaagatattataataagagcagtgaatgtttaagatggcccagtttaatcctcttttctcagtagttatacttctaaggatatcactcataagatgaaagtgctaggtctaaacatagtcaccctgttacttagtatattgccataagatgatgtattttggaaagccgttataggtgtattacaatgttcaaaacctctcatatcagttaccttcttcaaacttcctatgatggaggtaaggcagggattattcccattttacagaggaaggcagaagttcagagaggttaaatgacttccacaaatttgctccactacttaataacaaagcaaggcagacctagaatttggatcccccaactcctagtccagtggtagttgaagactatactgcttacataaaatgagagtagcttgttttgtaaacaggtttcagccaatggaatatgcaaaaatggaatttttacagaagcaagtagaacccaggtgcctcagtggttacaacagtagtcatacctttatcctgacaagtttttcctcctgagggcctaatttgctaataggaagtaactagcttttgtaaaaaagaaaaatatggaatattaaaatagaacacaggagtggtgcacctatcatccctccccttagattcattcatgatccagaatgtaaaagatatttgggccgtcttactcatttaatgaacaccttccttttctgctcagaatcaatatgtattcgcccaagatgctaagtttatgccagaaatatgtatgttatgtggaatttcttttaaaattcttattcagcgtgtactgtcagttgctttaaatacttactgccaacaataaaatctatttttatgcctatctttctattgtagtcaccacatatactttcacatatttccaatgcaaaaaaaaaaataaatttgtaggcccacacaatgatagtctttataccaaaaaaaattttaggtgtaaacaaaagaactgatctctccctgtgtacagggaaatgtacttcttgtaaatccaggagttaagaaattcctgtgggttccctcttgtaatatgcccccaaacaggatgtttgtttacagagcagatgtctcagggattagaacatgctttgcagaaatcagtccctctggaactattgctctcacaaatgagtgcctgcctctttgaaacctgcagggctgctgttgtcataggaagaactattctgagacacttactgttacctaagtataaggaaggcttcagaaggcttccctaaggagggttatggcacagtgtgctctgtgacccacaaatcagaggatgaagcaaaatggcatttttttttaataaaaaaaggaaaaaccacagtacttaattcactttcctggtagctaagtagacagtaaggcatttcatttcttacaggccaaaggcaacattttgtaaatgacttgtttggggcactaactgacagccttttagtaacagataaatcaatggaccaccgaaagcatctatcatccagctaaagagtaacgaagtcactaaggatcatttgttagggaaatgaagaatgtcacccataggaggtggatggccctttaataagacttatatatcctttcaacatggatttcccaaatcaaggctcaggaatattgagatgaaaaataggcctttaaatatgacagatctctaacctagccatctccactgtttctgccagaagtggtccctgtgactacaaaagttgcttggctttaggaatatataacactgaatgaatacagattgcacctgggcagggtgagggggacaaagggtggaaagaaggacaagggcttctggtgtcaagctagggattatgagataagtgcacctcccaggagggcctcgaccccagcaactacactacaagcctcctaacggaatgttttattaggcttcctttatctcaaaggacttaatggaagaccacaggatagagacatatgggtatccagccaatgcacaaatctgggctgcattctgactttgagcacagatttaatttattagctatctcagtttaaaagttagatataacagaatctggagcatgtttttaactgcttatataccactcagaaaagagttgtgcctactttttatgtgcctagctctgtgctgattattgtgagggatactacatatgagacaaggttccctatcctcaggtaattttcaacatagttgcagaaatcatacacacacacacacgccgagtttgtgggaaatgtccagtaagtgatcttagagaaaacagatacagtggtggggaggtcctccccattccactcccaccattcattcttcttttccacctgagtgaaacagcaaccatctggaagcctgcccccaccatggcatgtgtacctttagcagcacacagctatctagcttgtcttctcacacctttttttgttgtgtcattcaactattcaaaaacctttctcagcatattttgtattactacctccgatttcatctttcttcccttcctgatttccaaggctacaccctacttatttattgtgtcttctcatttcctcatcaacatgcaatatgcatccctacttccaaccttttacctctactgttcttcctcgttgagatgacttacccttgcatctaggtatccagtctttaaggcccatttctcaaaacatacctcctccagtaagccctgactgtccaccacagatttctgtgatcttttcttttgacatgctactatcctatattctgcccaacttagcacctaattttctttggtagtttctgttgctatttcttgtttattaaggttatttccccagttagatttcaagttcagaatattactgaagtttctaatgaatcacccagaataacctgtcactacagtgatccacaattcaatatagttgctaactgactcactgattcaaaggaaaggaagctgggacagtagcaggaggaagttgtgttttagagccaaggttgtaaaatgcttgcctcatagaactagtcaaactatgtgtttatttttctttagaaaaattatttctgcagtaaaaatgctttatatgatattttgcttttagctttctgtattaacaaggcttcaaatgttgcttttaaaattatgacatgtaccataatattttgcatgcttttcattgcttttaaaaagatgattattgttttgtgcttttaggctaaatttatgtaggaaagcatttccctatgtctgtcttctgccatcctttttcttttcctgcatgctctgttttcaagaagctagaaagagttctaaaaaataaatctgaaaatgaccatatgacatccagtgaataggcccaacaaaacttccaggaattttaggggaagataacaaatggaactcctacaacaaggaagactcaggtgagagctttctaaattgctttcagaaggcagccatagcaccatccagggatttcatcttgggggagaattggttgctttgctcaaccttgaaccatgcccagctatgttaccatatatgcctttggccccaaagtggtacctggcaagaggtgtgcctgaatgaatagagtcatccccactgttgggggaaaaacagcaacaatgccaccaaaaacaacttcaactacaaaaacaactgtaaaatatactcctcacccttaggccttcttggcagacatcgatcatcttctcctcttctatgaacacataacagcaaataggcatgacctgtccccatatactgggccttatttcatataatgaaggtcattcattcatccattcattttttgttcatttgctttttcattaaacattgagtcagatgctgtgctagataggtgctggggtacaaaggtgaaaaagtcccagtccctggccttaaagaactgaagctctagtcagggacacagataagttattcaatgattagagtttagtgtgataagtgtaatatgtaggagtgagaactgaggagaggcaattattcaagactgaaggaaggggtggttagggaaggcttcctggaggagaggattattgaactgaggtgagtcttaaaggaggcatagaactagccattaaggagtgagtggcatgccaggtagaaagaccatcattttgaaggcagcaggcatgacacgctcttagttgagcttctatgaatacaactacaagtagttcagaaaaactggtgctctgagagtgggagaggggtagagaagaagctgtggatgtaagtggggaccagatcctggagggcttatctatgccatgctaagggctttaaatttgattctgaaggcaatgggggaatattgaagcagggcaatgatatcagatttgtgtttcaaaatatcactctagccacaggaggaatcgggaagagggggaaagagaccagtcaggttgttggagtcatacaggtgagaaatgagagtggcctggcttaagggccactaatagcaataaaagaggacaatgcagagggactatttagggaggagaattcatagaactaggcaactaatcagatggtgagaggaagagctggagaaggttgagttaggaaacaaaagaagagttgttatttcctgtttttgatagagaaaagcacttaattagttagataattaatgaaataattaggcttgattttgaaaatatttagtgtgggggtctgtgaggcacctaaatagaggtgttcaatagccagttaactacatggggttggggtgcaacagagatgtcatggccggaggtatatatggagaatcactagtgtcagtggggattgaaatcatgcatgtggatgagatgacccaagggagaagtgtgttgatgagaagggatgaagagccttctgcaaatgaggctgagaaagaaaactgagaaatgcagaaatagactctaagaaagagttgtatgaaagaaggtgggggaaatgttagcttcaagaagttcgtggtctcaaatgtcagttttgactgagaggtccacacttgtaaggacagaaaagtagccattggtcaaggaggaggctaatttgtgacttcaggggagtcattacactggtttgaggagtgagagctaaggaaatctagattaccttttcaagaagtttaacctaaagaaagaaaagctaagactataacagctagagaagtatgtgaagaagcagaagcattttaatttttaaggacaatagtgatctcagcatgttttttaagccaaaagagaagtgccagtagagagggagagattgaggatacaagaagaaatagagcataattggtggattcactttaggtagaaggtggcaggagtgagacaggagaagagaagaagatgctactgctggagataaattcataggggcgggagagaaagtgaaatcaaaggaataactgaaaaaaaaggagtccctccatttatctcagtgaagtagaaggaaggtcatatgctgaaagtaagggaggagggggtagagctgaagttagagtggagttctgaatttctggaatattgggtgtggtgattggaaaaggaagttggcaaggggtgacgaaactattgtcaagcaccattaatgacccagctatcataagcaccaaccaatctgcatggctgtgtgatttccctccagcaactcttggcagccttgacatagaagtggagagctttcatggttggattctattagggtagggtttcataggacaattataacaagaagtcaaagagtgaaattttccaggacagaagcataagagcaatttacatgctggacgatagagtctcagccagaaggaagctgagaaattggctaaaaatggcagtgactagaatgatattttgaaactcaaatctgctattattgccttgtttcaatattccccattaccttctagaaatggaggtcttgttgagatcaaagaacaagtaaaataggagtaagcacttgaaacaattagcaggttagccagatgggaagctgagctcagagaatgagataacaaggttgaatattgcagagaaagggttattctggataataaaaagatctggggcaactatggttcttcactctggctgtgcattatctctggagttttaaaaattcatttgcccaggtttcatccccagaaatcctgatatagtaggttattggtgggctctagatattggtattttatggaactctacaggttattctgatgtgcagccctgcttgagaaccaatggtttaaaagatggctgtgggaatgattgcagaagtggaagggaggtaaaattcattagagttgagagagatcaaggatccataaggaaagggtatgaaggaggtgtccattaataccctgtttcacacagtggtggcagcacagaatgtaggaaggaagactgggagccaaagtactcaatggagaacaacgcacttggccaggagaactaggtggtgataatctcaaaagagaggattttgtaggcaagtgtagaagtactgatctcaaatcatttggagtaaaaaaagagaaagtctgccttctccattctctcaggactacaggcttgggatgagaaagggtgagcagcctccaccagtcttatctaaggaagcggtaccctcactggatagtagagtctaaagtcattgttctcagtcccagctaagtaatataaatacctgaggagttttaaaaaataaagatgcctaaggctaccccagactaactgaatctgaatctctggagatggcatctctctttttttttaagttctcagatgaaaatgatgtacagtgaagtatgaaaacctaaggcaagaggtgaaggaagaggtagaaaatgtagaaaaaaaatgtttctgataggacaaactcttgcaggtaaaagaactgcagaacattggggtgggcatataaaaggtgatagatgactagagggacttctcattctttatgaagtagtagaatagagaaagatgtcaggatgagagattctggagagattagctagccccaggaattacaaccagaactcccaatagatctcaaggccaaatgctgtttgcagtttgtggtccaggcagcaatttgtagccttgttctgagttccaatagaatatgggaggtacacttagaaagtgatacttttttggacttctgctctctgcaaatatcaacccagatagctgaccaggttgagctttaagataaatgacaaatgctcacagaattttgcagggtgatacagacattttagtgtatctaaaaaacaaaacaaaagaaaaactggttttcatctagggtctagtttattgctaaacacttactgaaagctagagctcaaatcttttttttttttttaatgccactgagtaataaatagtttaactgttgaaaactttggttctggagacaaagtggggacgtagattcaaatcctggctctgatatttgccagctgtgtaaccctgggtatatgatttaaccccaatgagtcccacttatctataaaacaagaacaagacctgcctcatatgactgttgcggagattaaatgagatagccccagatacttggcacgtggtgagtgtcccattcgtgatagctattaagtctgcaggtacaagctagttgctggggaatgtgagaataaataaattacactctttactgtcaagtatctcaaattttagatagagaggtagatatgtaaaaaataccaatcctatgctgatggtaccaagctcaaagtagacactgagtagttctatgggagcatgaaaggacaggcatttaactttgtctgcagaggggagataggaaaagacttgccaaaagtgaaaaagcccaagagtgagtctttaagagtaaggactaataggagtgatccccataaatttgggggagagggtaagaagtaagactttccaggcataggtatagcatgtataaaagcttggaggtatgagaaagcctggcagtttagggagcattgaatgtgtataagtagtggggcacatggcaagaatagagaggttggagtggtaaacttaggaacatatcatgcaggcccttggatatcatgctaagaaacatgaacttttaacttatgggtaataggggacagcatttaagcatcttaaagtcaagaatgttattcaggaggctgaggcaggagaatcgcttgaacccgggaggcggagtttgtagtaagcagagatcacgccactgtactccagcctgggtgacagagcgagactccaccaaacaaacaaacaaacaaacaacaacacacacacacacacacacaaatgcaagaatgtgatctagccacagagtagagaaatgaatggaagtggataaaattggaggcagtgatgctaagtgagaagtgatgaagccttggactaagttagttatttgtggggatgaagagaagaggatggattcaagaccagtttaggagatagaatatacaaaacttgatgatgaattagcatagaaataaaggagtgaaagatgactcccagattcttggtttgggcagctgggccagtgctggattactcaggagccagaacaagcatttgtatatggcatctagtaaatctgaagtacccaaaatgtggaaacagtttaattttgaatatatagcttaaaaaaaagactcaatcaccataggaacatcagaaattttgcacttccttaattgtttatgccttagtattgtttttatttgaattgcatattggagaggaggatcataattttttttcattgcttagagccgcctaaaggaggaggagcctaaggccttgcttcttctctaatctgcgtggttagtggtatcatttcactgtgatagagaacaccagaagaggagcaaacttgggcttcctgcctttgttatgcttagccctgagtgaagaaaattgcatagttaggctgataaggcattggcagtctggtggccttctaggaaaacaccattaatccaattctgcatgtaactcagcccaagtggagtgttgagtcaatttgctacaaatattttgccaatactaatagaaaagttgggagagtttatttgctgacaagaggggccatgaattcaaattgatataagatttggaggtacagattaaggtaggggctcttaactcagagtccaggagaattatgaacctgtgaaagtatatgtatatagtacatttttatgggcagaagttccatagctttcttcagatttttcagaagattgaccccaaaaagcttaccaagagctaattactgtgaagtgaatgaaactgctccttcagagttactcacttgcctggaacccttccagggccctggaggggccccggtacatttgtatttgtaattttataatgtcttttacttaaagggaaccttcctctcaaattacatgaagtatttggtcccccaacatgtggatccacccctgccaaccacagattagggaattacctaacatgagttagtatttgggagtggaggcaatccaatagagaaagaaatgtagaaggccaaaaactgtactagcaaaggcaaaagcaatgacaatcaaagaaagaaaggtcactgagaaaggaggaatgccaggccacattgtcaaggaagtagaaagagaagtagctagccatggccagcatgggtgggacatcatgaaagagaaaaagtaagaaaatgattacaggagtggctaggacaccttcaatagagtgatgacaccagagtgcctttctgaacaagtaaaaaatggtagttgaacaagtataaatgttagctatagttcacaaacattcaggggaagtagaagtaccaacagaaaactctaaacttcactgttaggataatattcatgaataaagtaggctcactgtaaaaatggaatctgtaatgagggtaagttatatggcatatatgtattttttcaaaatgaatcctaaatgtgctccatggccagacaaaggccttgggtgactcttgttcccctgctcccaacctttctttcctgatcctgtatagttcctctcactacttcagttttcttatttctgccccatatctctgtcctgtggctggagataaggaacagtgagagagagtggaatgagacaagaagccataagaatagcctttgaacatgaaaagttttgaatttaaaatttatcatgggtaacccacaaaaccaataatccatatacggttgaatgttgtctgtaattcaggccaaggcaacatctatttgaaccagaatgttctaaattgaccgccctggcaattctgaagttgattggtcttaactgggtaaacctggttcatgctgacttgccctgtattaggagggtgagtactatttttttcagtgtgaaatgcagcctcaccagagatacatgctcagatctgctaataagtgtgttatggaagcgactagatgccattttagagtgtttccacagtgacttcctcctgggaactatttccagatagactatagttctcaacttagtttattcagtgattatatctttataggcttttaaattatgagctactgatacatttatttataattatgtaactatgaaaaatctgctacttgaaaaagacaatgatttttgaatggctgatatgacaaaatataatggaaacatggacaaataactacaaactagaaaaactaaaccaaagaatggctttaagttttctgaaaactaaataaaattaattcagtaaaaaaagcagcaatttgtagctttttactagcaaagtgctgggtaggaaatgattgaaatatttttaataataaaaaaggtttgtaacataattgatttgcagtggtattcttgttaatagaagagtctattaagatatggttaataatagaaacatgttaaattaaataagtaccaaccacttgattattagctatcgttaacatagaaacaattcacaatatctttattgaaagctgaagtgcttttctattctttctaatagtatgccttagcttgacttgtatatgatgaatttcttccttagtaagtgatatttgattcaacaaagccagttaaacacaatatccctagatatctcctggttacactggtaaaaggcataaatcagtttgaatgagagatttgtttcaaatgagttttggaaattttgaattatttggatatgacatttgtcatcaccctcttagctacttctgcaaataattggaatttctggagttaagtgttgttaaaattgtgttggaatcaattgtctttcaactttgtaattgttttgatgaacctaattgtacaacttgtggatgccaaaactataccccaaataaatacatgttaacattttgcctttagccaataagaagaaggagaaagagcgcccagagatctctcttccttcagactttgagcatacgattcatgtggggtttgatgcagtcaccggggaattcactgtaagtaagctccttgttttgttttgtaagccacgaaagaattcctttgtgaaaatagttttcaagcaagaattgccatgtcccaaaatgtcagacttaatatttttgatggttccaaataagatggacattgcctaggcaatcatagatggaaatagaggatggcaacagcattgaccaaattattttgtccatcttttaaaaaagtttgatcactgtatagtctcaacttggttgaaaatattaactaaccatggcacagaagatgtactcctggcagacagatactgcctgagctttttctttatcaagtgaatggaatcagagaatcatctactcaccttggccagtgaaaataattcatctgaataattcaggctttacattaaaacctagaatacccagatcagctaactacgctaaccaagaatctctatggaactgacctgtttttccctttgatttctagaacatagataagttttacaatttttagtaggtatattttgtagattttcaaaaaacaaaccttatatttcaagaagaaatattgatggatatatcatgtatgttctagttgttttgggcatctctctcctctctctctagatatctctctctagagatgtcatgcaatccatagtacataccaataagaattcgctggacagaccatagctatagatcaagccttttgctgaatatttgtagtgctcaaatagcacaagatctcagatctatggaattttatacttttcttttttaaaaaaaaagaactggtatcttttttattttattttattttagctcaaggagagaaaagatgtggctattgctagaaatatgtccccaggaaggtcaactaccttttcccatactattagtgaactccatcaaaatgtacattctgaaataaggagtaattttgagggcatttcaaaaaaaatctttgatagagccatcaccatcaattcttgggctgttaaaccagagagaaatttacatattaagtagttgagttttttgtttcataacatagtagtgaatagactgtgttatatgattaagcggaaaaaaagaaggaacaaattaatctatgtggagaagcaaacaatgttgctgaattgacagtcaaattatcttatttcttcaattctggaagtaagtgataggagaatggaaatggaaacagtaaacaccttggcctcataaagtggtgtaagctgattatttctgcgttctcagtagcaagcagaggagaacgttaagaaatattgacacataaagtggagataggtaagatttaaccaatttcatcattaaagtcagagacattactcaaatggctttgagtgtgaacccattctttactatatttgcagaatattctcttagccacacttagatactccaaccttgctattatgactaccaccaccatcatcaccaccagaaaaaaacgtaatttgtataacctgaaaaacgttctatttttaaaaaattacaaaaagattgtaactatttttgctgacacttgaaacaagaagatcccttaaactttataaaaattttgcctaataactcttcccttttttattaatttttccagctttgacattttaatgttctctgtgcttttcctcatttaaactactattgtgttttattgttgtcattcactatttttcttttcttttttcttcctttttgttttctgatgtgaaaattttctcatccagttatctcatgtgatattctagttgctctccaatattttattctttccacttttcaaacttacttgtcatcttatgatacagtatatctctagctctttcatttatcattctggattctgaatggaaatgaaagaaagtaaatcaccaccatcttgctgactgcagcaccagtcattttcaatttgctgtcaattagaacccaaagaacccaaagtgatggactatctttccaatgatgaaaaacagttggatacaaccaaaccatatgaaacaaatactcctctccctactaaaaatatccccaatttgaaataagatagctgttcggaagtattccattgttacgaatccattgaatatatagaaagacataggctaaatttggaaaatggaagtactttattgtcatcctgatgatcttttgtaactacttgttcatacattattcttaaagatgccaaattctgccctttttggtacttttttaacctgtgatttacatttactatattattatgtttattaaatgtaaacatgccaaattataaaaagcttttaagaaagtctttttattggtaggatttagaattgggtcctaattgtcatagcaccactaatttattgtgtgttgggaggggatcatattaagtttgattatcgtggttgttgaggttgaattttgtgcaatttgctgaactatctaatccagttgtcttacaagggcttgttattttgaatatttggacactgatttgctgtgttgcttggtgattactctttggctaattggcccatatgaccttgtatacctggtcatacacttggaccctgaagctaaaagtaggttgggaggtgagatttttggtattcaatgattataagtcctcatcctttatattgccatttttgtcccaaatacttcagaactcccctttccagacctctagacctgtgacggtcgcttcaagtcaatcagagggaaaaatggtatgagtgatataaattatcatttcttatgataagataaatgcttggcctgttatatcgtgctgccattctcctgggctacactggacaacccccagcttaatttacttctagttggtatcctatacacagtcagacattgatatgtgctcctgcttctgatgctcaaactcctaggtcttcattagctgtctaacttttgggattagttcctcaacgtggcataatgagatggctttatgactatgtgcctttgtggcatacattcaaatttgaatgtcgggttttagtgataattggatttgtctcaacttagaaaaaagaaatgtcagcagtgtagtcaaaattatgtcagcagtgtagtcatgtggtaagtatagttgtctggaggattttctgctattggcagcattttttcctgctgtctagtgatcataaaactatttatcacaaaagtttagaagtgccatgggaatgtataataactgccaatattctaatgattatggtaatgattatgccagtaatgtctgctctagtggttatgtgcaatgcatacctcaatttgtaacacttaataactcctttggccattacggtattaacaaatgctattaattgcacttagaatcataactgggatcatgcatgggctcctgagttcaaatttttggcttaaggctttagcatctagctgcgtgaaaaatgcatgtaaaagtgtcgtttcactgtgcttggagtaaccctaaataccaggaatcaaggacatatatacaaaatcaagccagttgggtcaagcatgtttctgtagcatttgagatatctttatttaggcaaagctgttaccttatatcttgtcttattttgtgggaagtgggattttagaactgcagcactaaaatggaaattatatatatatggtttgaaatggaattgttcccctttccctggtctaaatatctaagaaacttaacatatagagtctggctatgtgggaatgttctttatctagttttctctaagccagccatgactttagctacaaagtgcaaaagaatcacatcaatgagaataaaattcaatgtttccatacagccatcctttgaattttagccacatacacacttttgaaactaaaattggttaaccagaattgggaactgaaatttgtaagtttatcacatggccattggctacctgtgatcacccagttataaaaacaacttacaaattattgtcaaagcttttcatgatgccatccttcttgcctccaaattcatgtttctgccttttaataatttctccaatcatttaatggtaattcttattaatacatatttatggaggaagcatcttgccaaaagtggaattatacatccaaactttgaagcatcgtcgttctctctgttctcttaaatctgttgtcctgtagcctgtcctgtccctgatttagttaaaacctccctattttcataactgccccactttagaagggactccccccattcagacccattggtttcatctcctcccaccttctaagttgtcccacattctgttttaactttcttttctttctttatttacgtccattacagccagatctctatggctcacagatgtgcccagggaagctcccagaggtgcgtcacaggcccaaaagaagcttgcatcaaagtgcttctttgagatgtcatagcactgcagcagcaggttcatgtgtgtgcagtagagttgttgcttggcttatctcactttttttgttgtcattcccaaactctggaggcccacgtcacacattgttttgccgagacttcataggataaagccacataaattgtgtctggatgcacttcaggaatagtgtgtctgtttctctctccaagttgctcttggaggttggataattatgaaattgggacttctgtaggctggacatgtaggaaagaatgttgaatgctcaatgcaaagctaacctctaatttttgcaattctccttggttagatttccaaatattccctcctctctgctctaaatgcttcagattattataaattatcacaaggctttgtcgtggttttcatagtccccaggttctatgtggcctataaatgaagtaaggaggaagggagagagagaggagaggagaaggagggcatgccctggagaaagctgcaggggaaatgcccaaagcagcattaatgttactgtttagcatctcagtggttcttgcccctccacaattctatttttgtctcctaccaacctgcctttatagtaaagcgctagacccaaaaaattacattttgtaatcacaaagtataacctgaccaagggtgatcctttccttttattctaaaatatattctgattacaacatgaccagaaacagcttgttattccagtcataaaatccattgatctgcactttactatgctgtgcacaaatttagagaagtcttgctatgtctgccctgagtcgccagaaaaaaaataagctaagccgtaaacatcatttcatggatgagcagagtcaatatggaggtgattttcatgcgcttttttttttctatcacagtcatactcccacccaccctttttaagttggatcctagttttacctatgtgttttaattagagaagagaatgattgcattattaagttactaactttaaatctagaatgtaacttcagtttcccaagtgtaatcctacaggtagcatgggcttcttggtgaagaactttactggaacataaaaatgctgctgcagaatgttctgagctaccattctttccctttggttgtccacagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggaggtaagaggaagtctgtggtatcaaaggtgaaaaagtaatttcaatttcagagtgtcatgttgagaacaaaatgtctgtgggacatttgaaatcgattctagtaccttcttcaaatgacatcaacataaggaaaccaaaaaatgagttggaatttgaggttgatgttaagttatataactcaagtatgtttagaatcaaaataaggtaattatttagtgaaggagtagttgtgagcttgaactggtagtcacaattgttgtctctttactgtcataaagacactcagtcacttactgggctttgttatatgttcatgaagtaagagttgtatgtatgaaaccatgctctctggaaatttactttgtcccttagattcattgatttacaccatgatgacacagcacactgtttttttggtgtcaggttattttgctaagacccccaaatcagactgaaaagagaaaactatgtgtgactatttttagaaactgaaatatccatgttactgccaaatcttgaccttatttgctagtgtgtagatttagtcttttcttggagctttgatgttcaaatttgcactataagcaactgtattagtccattttcatgctgctggtaaagacatgtccaagactgggaagaaaaagaggtttaattggacttacggttccacatggctggtgagacctcagaatcatggtgggaagtgaaaagcacttcttacatgacagcagcaagataatatgtgaaggaaaaaagtggagaaccccgataaaaccatcagatctcatgagacttgttcattatcatgagaatagcatgggaaagaccagcccccatgattcaattacccacccccgggtccctcccacaacatgttggaattatgggatatacaattcaagttgatatttgggtggggacacagccaaaccatgtcattctgccccggcccctccaaatctcatgccctcacatttcagaaccaatcatgccttcccaacagtcccccaaagtcttaactcatttcagcagtaactcaaaagtccacagtccaaagtctcatcttagacaaagcaagtcccttttgcctacgagcctgtaaaatcaaaagtaagctagttacttcctagatacaatagaggtacaggcatttgttgaatacagccattccaaatgggagaaattggccaaaacaaagggattacagggcccatgcaagtccaaaatccagcagggcagtcaaatcttaaagctccaaaatgatctcctttgactccaggtctcacatctaggtcacgctgatgtaagaggtgggttcccatggtcttgggcagctctaccctgtgactttgcagggtccagcctccctcccggctgctttcacaggctgctgttgagtgtctgcggcttttccatgtgcaaagtgcaagctgtaagtggatctaccattctgggatctggaggacggtggccctcttctcacagctccactaggcagtgccctagtagggactctgtgtgtgggctctgagcccacatttcccttctgcactgccctagcagaggttctccatgagggccccacccctgcagcaagcttttgcctgagcatccaggcatttccatacatcttctgaaatctaggtgtatgttcccaaacctcaattcttgacttccgtgcacatgcaggctcaacaccacgtggaagctgccaaggcttggggattccaccctctgaagtcacagcccaagctgtatgttggcccctttcagataaagctggattagctgggacacagggcaccaagcccctaagctgcacacagcacggggaccctggagctggcccaaaaaaccagtttttcctcctgggcctatgggcctgtgatgggaggggctgctgtgaagttctctgacatggcctggagacatttcccccatggtcttggggattaatattaggctccttgccacttatgcaaatttctgcagccagcttgaatttctcccaagaaaatgagtttttattttctatcgcatagtcaggctgcacattttccaaacttttatgctctgtttcccttataaaactgaatgcctttaacagcactcaagttacttcttgaatgctttgctgcatagaaatttcttctaccagataccctaaaacatctctctcaagttcaaagttctacacatctttagggcaggggcaaaatgctgctagtgtctttgctaaaacataacaagagtcacctttgctccagttcccaaaagttcctcatcctccatctgagactacctcagcctgaattttattgtccatattgctatcagcattttggacaaagtcattcaacaagcctctatgaagttccaaacttccccacatttttctatcttcttctgtgtcctttcaaactgttccaattgcctgttgcccagttacaaagtctcttccacattattgggtatctttttagcaacaccccactctactggtaccaatttactgtattagtccgttttcatgctactgataatgacatacctaagactgggaataaaaagaggtttaattggacttatagttccacatggctggggaggcctcagaatcatggtgggaggcaaaaggcatttcttacatcgcagcagcaacagaaaatgagaaagaatcaaaagcaaaaacccatgataaacccatcagatcttgtgagacttatccactatcacgagaatagcatgggaaagaccggccactataattcaattacctcccactgggtccctcccacagcacgtgggaattctgggagatataattcaagttgagatttgggtggggacacaggcaaaccatatctgcaactgaaatatatataccaaataatactttcacattttgagatagatgatttgagttctctctctacaataatttattaacttattaacatctaaagaatgaagggagtattatcattagtactacagctataaagagcccttacctcttcgcactggatttagtataagcaggctttaagtttctttgagaatgatccaaggatacccttggaaagggaagagtgtctgatttggccatatcaaatatcaaagcccaaactgctaaattggactattgcttaactgctgttatccaatgttgaaaacctaaaaagaaagccatcaagggaaactttttactatatttaagcttccacatagaataaaatatctaagagatcctggtgatatatcaaaaaatgtttcatgtgagaaaatcaagagctgtgctccaagttagaaccataggcaaccagaactgaaaatgtattcaagaaatcatttcactgtaaccaagaatacactttagagtatcagagtttgttctttactccaaatagccattgctgtttaacacttagttttatatgccaaatttctctcaacttacaaagatgaaatcctgacaactatattaaaactcaactgtacagttgtactgtactgagctgagtgtacctcatcataggttttctgaatgctctggtattgggactgactaactgaataggaagagaagatgaagatagcacaggaaggtggaaagaaggaatggaaaggaggtagggagagaagaaagtgggaaaaatcctagatttagagtagttctccacttatccatgtggaatatattctaagatctccaatggatgcctggaaccatggatagtactgaaccttatgtatatcatgttttttttctatacctacttacctgtgataaagttataaattaggcacagtaagagataaacaacaataaccaataataaagtagaacaattataacaatatgccagcatcactacttttgctctttggggccattatgaagtaaaataaggggtacatgactacaagcactgtgatagctccgcagttgttctgataaccaaactggctattaagtgactaataggctggtagtgtaaacagagtaggtacactggacaaagggatgattcacatttcaggtggaatggagcaggaccgcgtgagattttatcatactcagaatggcatgcagtttgaaactcatgaattggttatttctgcaatttttgatgtaatatttttgaaccacagttgaccacaggtagctgaaaccacaaaaagtgaaacttcagataggggggactactatagatgtacagaatcatacctgttaagagtaggtaatcttgtcattcttccatataaatgagattcactggaggccttcattaatatctgcaaaatgacctggtgagaatatggtgaggatgtaatggtgtgagctattttaagaaaagctatgtcattagtcataatatctagttaatactaaattggagcatttccttctagttgaaatcatgcagttttttaatttttatttttctggtgtggtctctgaatgaaacattctttatgaaacaaaaatgacctctctattctcactttgcagataaaagtgcacatggatacatagcagcccatccttcggtaagtgaaaaattgaaaactgtttcacatgattggtgtttccaaagatttaagagaatataactgcacagatccagtttttagatataaagtcttttaaaaacaattttaaggtataattcagtttatataaaattcacctattttcaggtaaacagttcaatgagttttggtaaatgtatatacctatgctaccatcaccacaattgagttttagaacaagtccatcaccccagtaaaatccttcatacctacttacagttaactccacccaccccaccctagtcacaggcaagaactaatatggaatctgcctttatggatttggctttctggacatttcatgtaaatgaaataatacagcgtgtgacttttgaggattggcttttttaactcagtttatttattttaagattaatccaagttgttgtgtatatcaataatttgtgttcctttttatctctgagtattccatggtatgattgtaccactgtttgtttaaccattcaaacattgaaggctctctagaaaattttcagttgctagctattacaaattaagctactaggaacattcttgtacagggtttttatgtggacaatgtttctgtttctcttacatgtagaactttgagaataataatcatgttaatagaaatttctctgaacacctacagtgtacacttataatataaactgtaagataattttatttttataggtacttaatctttcctacagcccagttaagtaagtcttaccattgtccccattttacaggtgagaaaactgaggtttggagaaattaaataacttctctaaggttataacagtatacgttttgtatgtcacttgttccaacaaactgagatacagggagggaagtgcctttgtccaaagtcacatagataatttttatcagagaagtgactagaaaataagtaacctagttgttgaaagtgctatagtatctgaaagaatatttgtacacattagacagaaaatgatctcagataaggcttccctttctgtgattttcattttgatattctgatagaaattacttcctgcctcatttgtttttttaggggtgaaataatttgcattactgaaagtctcctaaccatttattcaaacagtcatggatggccaacctgattcttcttccttttatagcagaccaatgccttttatagtggacagatgtctgcttgacatcaccctgggtagccagtatgacaccagtagatcttctttagttgtaaagagtaaaggttctgaaatattatgtcagtttctcaaaaattaaaaatggtattaaccatatgatctagctattccacttctgggtatatacccataattgaatgcagggtctccaagagatatttatacacccacgttcattgcagcaatattcacagtaggcaaatggtggaagcaacccaagtgtccatcaacagatgaaggggtaaacaaaagatggtatgtataaacagtggaatattattaagccttaaaaagaagacaattctgacacgttacaacatggatgaaccaggagaacattatgctaagtgaaataagccagtctcaaaagggtatatactgtatgattccacgtatgtgaggtacctagaggagtcaaattcatagagacagaaagtagaatactagttgccaggagctgggagcagggggagtgggcagttgtttaatgggtacagagtttcagttttacaagatgaaaagagttatggagatgaatggctttgatgattatacaacaatatcctcaacagtactgaaatacatacctaaaaatggttaagatggtaaattttatgttatatatattttgctacaattaaaaataaaatgaaaaaagaaagaatgaaggctctggatgtaggtatttaatctgatttccccatttactaagtatgtgacattgggaaactagcttagcttctctgagcttctttcctcagctttaagagggaataaaaatagtacttacctcctacgtcttgtgtgaatattaaatgtgataatgtacataaagtacttagtatagtacttagcacataatatatatttattaaatgtaaactactattatttttacatgacaacaagaggaaaaactcactctcttcacacatgaagcttgtacttgcgctttgctcagattccccaaaacagaacagaatatggccctctcatctgactggccatttccttttcctccttctttgccatgacagcttcctgggccacactgaaaacaacatgtgaagggaggtaataggaaaatggaaaggacaaaaatgacagccttccatgatcaacacatactttacctcctttgacttcattaatatcatgcttgtgcaatcttgactgggtattctggcaaaaaaaaaatagttattatttttttaggttggtcagttatttgaaacaccaacttgctaggatagcctgtgtattggtttttgttttctcctaagatattaactgtttcttttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctcaaaaaaaaaaaaaaacccaacaatatggatagtattacatatcataaaatatgttgacatgctatgagatttcagagaaagtagattgcttttagctggggagggaaagggaagcaggcccttgtctccaagggctgaagctcagtgtctggtaccaaatagatacttggtatgtatttgttgaatgttaagttagaaaatgcttcatataaaagttggcatttgagctagatcttaaaggtcagatgagatttcgatctgtgaagatgggaagggcattttaagtaaaaagaaaagcataagaaagggtgtgttggtgagtagagcaaggaaacaaggaatatggggttgaatgaaaactgagatgcgagaaagggaatcaggaaataagtcttgaaggttaaggcggaaccaaatcatacaggcccctaaatggtactccaaggaatctggctttccagtattcagtgggaagcttttgaagtgttttggagcaggagagttaagtgattaacacttataccttgggaagagtaatctgacggcaaatgtccagaatgaattaagtacaaatggtgagactggatgaagggagactagtagggagaatattgcaagcatccaggtaatctgagccagaaatgaggtagtaacagtaggaatggggagattacattcaatttctagaggtatttagattattaattggatgttggaggaaagggtgaggtcaaagataaacgcaggcttaaactgataggtcgtgggtaaaaagataatgatgctgtctttcaggagaagccaatttctgtgggaagatgctgagttccttattggacagtttgagtttgaagggctggcaggactttcaggtgaaaataatggattgactgcttgatgaaggctaggtttctattgattgaatgaactgaattggaccccgacattctatttgaattacttcagtgggactcagttccttaggaatggataactgcaccttgtgttttccttatagttctagaggagagtatgcttcgcaatgtgtatgtctttttgcatcataaaaactcccagtagatctggctgtctacaaaatctgatttaatgggtctgacaaccccttgtagacatagcctgaattgattacaagttttgcatcctttagtagcctgggtgagaattaaaacagaagcaatgttgcattctctaagtgttttaaactcatgattctgtaattaatattgaactcagggatagatctcatagtcatataacacctgctttactgcttatttgtggtagcttctttgatattagtgtattcaatttcaaatactgttcaagtctctactctttaatttgaggctaattttaaaatttcatatttttatcgtactgttgaaaataaaatgacatatttagaatcctaagttagtattccaactggaaggtaacagcaataatatgtcattattgttttgtcatattgaacgtgccattatctatgcttagagcaactggatgtgcagttgacagattgctcttttgtgatttgcagtactggttaattttttttaaacatagtttaagtaattcttttacttcagtgtgcatcagaatttcatggggattctgttaaattgcagattccagggctccactcccagagtagatctggagtagaaacctaaaatctacattttaaacaatcaccaaaagtggcccccaaacagcattttatattatctaaagcctctaagttccttacttctaagttctttgacctttaaaaattaagctcagagaaaaggaaatttcctaaggtagctactctagctggtgtattctctagagcaacgttcagaacttggagttcatgggtgggcttcagatctatgaactgttgaagttatacataagagcatgtgtctacctgtacctttccggggagatagaccaaaccctaagagtccgggacccaactcaggttaagaacttcattcccgaccaggcgcggtggctcacatctgtaatcccggcactttgggaggctgaggcgggcggatcacctgaggtcaggagttcgagaccagcctgaccaacgtggagaaaccccatctctactaatacaaaattagctgggcgtggtggcacatgcctgtaatcccagctactcgggaggctgaggcaggagaatcgcttgaacccaggaggtggaggttgtggtgaacagagatcgtgccattgcactccagcctgggcaacaatggcgaaactccatctcaaaaaaaaaaaaagaaaagaaaaaaaagaactacattctctgccccaatgtctagcaaaattagagtgtcaaaaatatctaatttgataagacaaaaatattccttacttgttatccatctatctatatttctgtaagtttagaagttttagatacagtaattctcagcctggaatgaagagcatggaaacattgcaccattgactccaaaaatgatcaccaggaaaacctctaagtaaagctatgtttattaaacttagagtgacataaaagcattactttgataaagtctttgtgtcttaagaaggggatgtcaggagggaatatttatagggttttagggcttagactgtttgattttaaagcaggtcttgcaaggcgaggaatgggttaagattatgcagtgtttatgataacatagctttgtattggtgaatatagcaaaggaaggggcttgaagcaagttttagtgagcaagctgttagtctcaatgagcaaactagttggttcacggtatcttctagaaacaagtatttcctaaagtaagaagctatgttatttttgcttattctcactattgtttaatataagaacattaaagtatgtctgtcttgatattgactaacacagggaaaataaaatatgcccagtcccagtactatttacacagtgatagtaaagtacgcctaatcccagtattttttaactcagggacagaaattgttaatttcagttctcagtaccaaagattgctatccttggtggattgctggggatttaatgctctctggcccaaccataattcaaaacatactatccactcaatgccatacattcttccaagtcaaccaaccaatatggcaggatagtgtttggtccaaagtaaacagaaatatctgtctttttcttttcccacaaaccttcagaggacaaaaaccttcaggttttctaatagtcccttaagtctatccttggagatggggaatggtttccactggaagttagcagtgaagatagtaatgaatgttaacagtcagtgaaatcttgcaggtggatcttatctagtgaagtattaagacttgaaatgtgtaaggctgctccttgccccagtaggcagactgatctttgtaccagtttaaggtttgggccaagaagactagaccttgaatcattctttttgcctctagggccgtttttagagcctaatagactgtatatactctcacttgtagaggtcacatcatgcattgctttaaacatattaaagggcccccatacttcactttatatttttgctgtaaatttttgaaattatttttgacatattaattttgaaattatttacttacaagtaacttttaaaatgtatggttaggtataatttcttgttaaatcattgtaaatactcaagaatttttgctaaatatgaaaatcaaacctacaatttatatttaatataatgaaatttctttaaatgctaaacataagagactagttaagttggcatattgttatacttaacagacatttaattaaacattaattaattttgactttatagttttcttgtggctttttggagctgatgatttatttctgatggcaaacactttcacgggcccatgtaaaacttatcaaccctgggcaaggttcgtattgcctaatagataaaatagcaccatttgtcatataaaaaagtactcagcttccatccttctacaaagaaacagtgattaggtacattcttgaacccagctggtgtaagatagggcaaaactttctggaacataatatcaaagcaaatttcgataacccaaagcccatttctccctgtgccccctgaaatgccctgaagaattagtgttttgcaagaagaaagtgattttttaaaaatctggaaacttaatgtcattaacagatgttgctatccacatagctatacaatataatagcccagttgttatggctaaattaagaataaatataggtgcataaataagaaaaccaatattcagtaaacatacaaacttcaatctataaaccacttagcatttatatcagggcaataaaatattctttcaaatgcttgtttataaattctaggttggctttcttctcacaattggtaagtctttctggctcctatcagatgtgtgattacaccttattacttcaccataggtttatacatgattgtagaaaagccacattgaatttttaatcacaattgaggtcctttgatgtaatggtctattaataggctgcctataactgcctcaggagctttgtcctcaaagaatgaaaattcattgtcggattatgttaggacagtatacccagtggcataaacaaaaacaaaataaatacacaaaaacaaaacaaaacaaaacacctataatagcactgtccaacaaatatataaactatagtcataactttaaattttctagtaaccacatattaaaatgtaaaaaataggtgaaataaattttaataatatatttattaagccaatatattcaaattttcagcatttcaacatataatcaatataagaagtattaatctaacattttacaattttttgatattaagtatacaatatctggaatgtaatttacacttgaaacacatctcaattcaggctagccacattttattttattttattttattttattttttattattattatacttgaagttttagggtacatgtgcacaacgtgcaggtttgttacatatgtatacatgtgccatgttggtgtgctgcacccattaactcatcatttagcattaggtatatcacctaatgctatccctccccgctccccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccacgtccctacaaaggacatgaactcatcattttttgtggcgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacaatccccccaactgtgtaaaagtgttcctatttctccacatcctctccagcacctgttgtttcctgactttttaatgatcgccattctaactgttgtgagatggtatctcactgtggttttgatttgtatttctctgatggccagtgatgatgagcattttttcatgtgttttttggcggcataaatatcttcttttgagaagtgtctattcatatcctttgcccactttttgatggggttgtttgtttttttcttgtaaatttgtttgagttcattgtagattctggatattagccctttgtcagatgagtaggttgcaaaaattttctcccattctgtaggttgcctgttcattctgatggtggtttcttttgctgtgcagaagctctttagtttaattagatcccatttgtcaattttggcttttgttgtcattgcttttggtgttttagacatgaagtccttgcccatgcctatgtcctgaatggtattgcctaggttttcttccagggtttttatggttttaggtctaacatgtaagtctttaatccatcttgaattaatttttgtataaggtgtaaggaagggatccagtttcagctttctacatatggctagccagttttcccagcaaaatttattaaatagggaatcctttccccattgcttgtttttgtcagtttgtcaaagatcagatggttgtagatatgtggcattatttctgagggctctgttctgttccattggtctgtatctctgttttggtaccagtaccatgctgttttggttactgtagccttgtagtatagtttgaagtcacaggctagccacattttaagtgttctgtagccttatgtggttagttactgccatgttaaacagtgcagacctaagccatagttgatggtttttaaacttgagcttgcatcaggatcacctggaaggcttgttataatacagatcgctgggctccacttccagagtttctgattcataggtctgaatggagcttgaaaatttgcatttctaacaagttccttaatgatgctaatgatgctgatctgggaaccacactttgagaaccatggccacagttctttcaaaatccaactttggaaccattttaccactgtattaacatgagtgatcaagaactgtccctaggtattgttgctattgtaccacaatactgtcgtattattgcagtttataaaatattgaaaatctccatttaactcatggttaatattgagtaattattcatgtggatgagtagttcttagatcttcatgtctattactctctgagtgcttctttccaggaggctggacagggaagagacatttattggcttgtttgttcttagtgagtatttacagagctatattaataccatatgtatatgcatgctctgatccttaggtagaaaatagttcttttcaagttgacaaactgtcaatcaataaattgataatctgcccagtatagattcaaggctctaagagcaattagtttgatttttaatgtatttcaaaaacattgaactttaaaatattaagtgaataatagtccactgtttttgagctcagtgagaagttttttaaaaaattacacttcatggttttttaagccatgacatgaatttatctctgaataagttcagagattgtattcaggtgagcaagtcctggccaccaaattgttgatgattctgatcatttgtgaaagatgtagtttcctcctatccctacatgcttaaatatttcatttcccttgttttatttctgaagaaaaacaatgaggagttaatacctgatctttaaactttgtttttgtcacaagagtacaaaaacagcatctgagcctccattggcccctcctgtgtctgaagaagaagatgaagaggaagaagaagaagaagatgaaaatgagccaccaccagttatcgcaccaagaccagagcatacaaaatcagtaagtcacaaaggactatttccaaatgattcaaaagatgccctttggaatagtcatagagttagaatatagttaatcagctagtacctattaagcatcttttatgttccaagagctaaagtataaaatatgaccaaggttttgaggatactgtttgaggatacaaggttagcacattaaacaattagagaataataccaaacaatacataaataactgctaagtaataaaaatgttggagaagttaaggtaaggaaggaaatccatgtaaaccaggtaggaagagttgcataaacagagatcctcagaccagaattagcaaggcatgtatagggacatccaaagactagctcccatgatctttcaacagtgttgtactttcagctactcaaagtcctttttttttttaagaaaataccacttgtctttaaaaattcattgatattacaatacattgactccacactctttccttggcctgctgttttaattgcagagctttttggtttttttagatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagtgagtacttcttgccatgattactttctacacgggagtgtttctcataagccatttaaaatgggaattgatcctttggaagttttaatctgcttatatgaactccagacttcccaaaatcatgagatgaaaaatttgagactcactgcatatgccagaacactttctcccttccactcctaatttgacaggaactaaatatttttacttgaaggaatcaattgaggtgaaaattgataagacaaattaagtagcaagttttaagattacatcttcaaaagagaatagtctgataaaatatgttatgatcataacccaagggctctcaactaatcagtgatgatagatatgtcaacctcaaagcccaacacagtcaatcaaaacttggaacaacaaataatatagctttttcccttaattcagaagcatttatatgtggcaggagagacagaactagcaaatgctagtagcttccttccacaatgtcattagtgtgtacatgctcgtgtgtacacacttgttgccccagttttataaaacacttaccttctagttacttttctgggtcaagaagataaaaaaaaatggattatctgctgaaaagtcaaaggtttgtaaagcatattcattaaactcatactataaaagcatctaacaaattgctagatatcagcaataagtgccccccccaaccccagtttgactaactcctacttatccttcaatactcagctcaaaagttgcctcctcagaagatgttgcttgtccctcccagtccatgttaagggcatctcttccttaccacttttactggagcaaatatcaaaccatattagtctgacttctttactagactgtgagattctcaagagcagggactgtgcccttttttccctatatgtccaacccctagttcatacccattacataaaggcatacagcaaatgcttgttgagtgagtgaatgaaaaaaataagtaaacaaatacatctttactgagttcctacttgtctgttctgtgcaagaaaccttggaggacacaatagaatgaaactttcctgtcatcaagaaattcaatcttttttggaaaatacgatttaatagtatgatacaattagagcataagataatctcgtttcatgcatatttttatttaaaagacctcagaaaaggaagacagtaattcccactataggccacagggaggctctgcagaggtggtggtaggatgattttgccctccaaaggacatttagcaatgtctggagaatatttttattgtcctgattcagagactgctagtagcatataatgggtagaggctaaggatgcttctaaaaccccaacagtgcacaggacggctgccctccatccactttacagtaaagtattattcagtccaaaatgtcaacagtactgagattgaggcatttgagttagatgcatttggaaaggcaaaggtcggagttgcagctgtcagttaaaactcagaactacaattgctagatttttgctgactttactattcatgattaaatatgccactagcactgatactaaccatttgctgtaataacagcagtaataattctcatttattgggcaccttctgggtgggccactttacatacattatcatagtttcacagtaattccttgcagctgattctaatatcctcattttacagaccagtgaatgaaagtaagctttaaaaggcttaactgaccaagtcaccaaaccaatgtgtggcacaaccaaagtttgaactgagaccagtttaccttcaaagcttacactttttccattacctacctactttgcttctgcatatccgaactgtctatttttgtaaaaaggaagaactaaatgaaagaattgcctcgataatttaagttcaattattcagacaattggcacgtttttctttattttgcatatgtagacatgacctatgtgattatatcagattttaaaaatctaacagccttgccttaataaaatgactcttatttggtatctgtttcaaatctcaatagatgtattacaacaaaaatgcttgtatagttttgttagctgacagagaaacaagcattattttcttggaccaaaatcttgttttgcttgtaaactctagtggtgctagagctgtgtccttattattttgtttattctgctctacactgagcaacatggtgaagaaggggaagctaactttgattacatttgaattaagaattcagtggggttttttttttctctactggacttcatgcttgggcatagagagagtcattttccctctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatggacacagggaggggaatatcacacaccggggcctgtcggggagtagggggctaggggagggatagcattaggagaaatacctaatgtagatgacgggttgataggtgcagcaaaccaccatggcacctgtatatctgtgtaacaaaactgcacgttctgcacatgtaccccataacttaaagtataataaaaaaggaaaccaccacattttagtgacaaatttcaaaagccattactgtcagtaaagttgtgtaatacaggaaatttgtcttcaacctccttcctctgggccccactatcacctactccttgcctctcacctccctcagcattccccactcaaaaccctttttcctaattcaccctcatatagaactgatatcaatttagagaatctttttactttttctcagaaatcaaaatcttcattatgctaaaaggataatcttttaatggtgggagttcaccttagcttaatatgtcagaaaatatattgatgggcttttctgtcactgaactcatatcatgaatgctattttcaaatacaagtatttagcattcttaaaacctgcactttaaaatgaatagtttatttcttctttaggaagttctggtaggaaattgttctggtattgcttttttttcttttgattttgatttgctgattttaaaaaactttctccctattgtgtcacagtgttttttctttatcgtaatttacaaaagcaaattataataactaatggaaaagatcactttaaaagcttgttttgtgattgagaatggtaaacaaggcctctagtatacttgcctaacatcagtagatggcagcacacactctcctgtgaagggcgatgagtgtggagacaccattttatttgaatagcagttaagttcagaagtggaatctcatcaaaatggtttcttttggtaatcttcatgaaaggatttatttccagttttttttccccctgcataacatggaaataaaggttgaataatttattaccataaagccacattaactgaaccccaccatttggaatgggtcataattcagaaagtggcttgggctgaagctttttctatatggaaaaaagttgcttagcaacttaatagttaaacttttttagaagactataaactgcttaataaaattatggcttcaagtgactttaaaatcgtcatttcattaaaataaaaaagtccaggcccttgcgcattaatagctaatttgaataaggatggctctcagttatatagaaatctgttagacaagttgaaaaataaaagaccaactcagaaattgctaaattggtggcattctatagatatagctcaagtaaaatatattctccaacccttgccttaaaccatggagcatttacaaagggaaataactaattgtattttattgtaattcagcaaatatatcaatatattctacacacggcattgtgtgaggaggcactgaagatacagagatgaataagacatggctcctgtacttaaagacatagtctaaaaggcaatatcaaataccatacacacacaaaggaacctatgcagatgactgtttagtacagagagtaactcagcacaagtgttacattgtgaccaagaccttaagtgaaccaggaagatctgtggaattcccgtcatgtatatcatgtacatttctagccatagatacaacattgaatggatgccagatgattatgaaacccttcagttctaattcttacaagtcaaagttccaaatagatagatatagacatctgatatattaagtacagagagagagagaacaagggcgagagagagagagagaagatacagtagtagcacagaaaagtgaagttgttaattattcaagggatcagagaaagcttcctagaagagggaacatctaagctaagtttggaagcatgaataggaacttgccacagagaaaatatgggaaggacatttcaggcagcgaatggcatgtaaagaagacttgaagcatatgtcctggaactctgacttattcagtgttactttaataaagaattggtggtatatggtgatactggcattgtagaagaggaaactgaacttttaagcaggagctgatcatgagctaccattagtttgttatgcttagagcataaagttctagtggggaagtggtaaatgatgagaagagaatgaagcaggagccagattaggaaccttgcattgccaaggagttttggctttcatctgtaggtgttagggagctatcaagtaatcctgaaccagagaatcacattatcaggtctgcacttagaggatcctgatagagatgtagagccttgactaaagagggcagcagctagactaggagtccagttaggaggctgttggaataacccaggaaaaagatgatgggagcccaactaaagcagtagtaatgaggaaggaacacattcaaaagatgtctaggaggtaacaagatataggcccttggtggacaactgcacgtggtaagtgaaagtaagagtcaatgatgacttgcagatttctgactcaggctactgagtagatggattggcagtactactgactgatagtggaaatacaaaagaaaaagtattataacaacccatatattagctaagtcttatttaacttaatttaaaagtgaactttcattaaaaaaaaaaccaacaacttgatgagtaatctatgagtgaaatgtttaactgattatttttctcaaggtatactatctactgctgttaggtctaaattatgttgtatactagcccagagaatagactgttgtgtaaattagcatgaagtattatctgtagcatataattgagcacttaaatacatattttcttgttctcattcatttaatcaacaaatatttgtttagtagcagccactgttctaggctccaaagttacagggatgaaaggacaaagttcctgccctcaagaagcagcatgtaagtctcagtgaaatgatcagagaagacttcataaaggtggataatttgagattttatttaaatgacaaataagaattcatgggttagataggaaaggaaaagggggagcacatgcaaagccctaagcactagatagtgatagcattactaggatataaagtagtaagggtggagaaaaagaataatataaagctagactggttagataggagccagatgatgctgaagggtgaaggaccttctctgtctaactacagaaataggatttgatcctgcagtgggcaggagcttttaaggaattatgaacagtggagcaaaatcactctgatatagggttattgtacatctcagtctgtccaggacagactcattttatgaatagtatggtcccccttttccaaaggcatggtgtaagaggaactagagaaagcagagtctatgagtaggttatgactggcacaattgtttgaataagaagtattgaaagcccgaacaatagcagtggccatgggcatagagagaagagtatgaatacgagtgacaactagaagatagaatttacagatcttctcttgattagttcatatgtgaaaatcttgccttaccaaccaactgtacacttctttgtaccatgtgttagtaagatataactcaaagataataatactgacatgtttgcttccagaaagaaaggtgggccagaggcctccaaataaatgatgcccttcaaagtatacccttgagaagctgcacccttattcccatgattgttctataaccccaagatttttctggacctatttgaacactgcattgaagagtcaatgccacttctgtggtatttattctgagtgatagcaagtattcatcctctgagtgatggactggatttttttgaaatagcaaaactattatttttaaagagccaaacatgataaattaatagttttcttatgtagcttataaacttactaaaaaaatgtttggagcaatctatagaaacagaaagtagattagtggttgcctagatatgttttgggaactaagggaagatggggagtaactgctaacaagtaagaggtaaaaggtttctttctggaataatgaaaacattctaaaattagatcatgatgacatttacacaactcattaaatatgttaaagacattcaattgcacactctaggtcactgaactttatggcatgtaaatcatatgtcagtaaatctgttcaaatctttggagcactagcagtgtcctaggtttggaaatatatgttttgaacatgcatgggtctcattactttatgatcaaactttgttcttcattagactcatttccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatttgttattttaataagtagaaagtatcatttttatgtaaattatagaaatcccatgggagtatttgtctaatgttttatttgtcactgactctggcatcttaattttcattattaaattaaaaaacagtcaatcaatttctatttctctctctctctctctctcttccacctcctcctcttttcttctctccccacccatctcttaggaagcattgtgagtgttggggacccaaagaaaaaatacacaagatttgaaaaaattggtcaagggtaagtgattgttatttgaaatataaaaagatgagtacaagcaacatacattaaaattaaaattcagtaagagcttgggtttctggtaaattatgcttctcatttcctagattatatttatgtcttgcattctcagtattggcctttcagggggagtgctgacaacagttacaacattaacctaggaacacatcctgctgaaatcttcattattgttgggctgacagtaaattctgtgtggacattttgatcctatgtagttagaagattcaaacagatttctctagaaaaagcagtagggttatggaaacttctagcttacgtaaaaaccccctttatcgcagttccccctacagccacatggatggtatgattaagatcctgttttattgtcaaaatgtggagtgacaaactgagggtggggaatgtccttatggaatgatccggaggtaggcagagttgactatctgagtatggaggaaacagacaataatccctaaatgagacctagtgcatcattttcacttaatatacttgttaaagataaagattcccaggccccactgccaaagatttgatttagagtctggagtggggttcagtgatctgaactttgcaaaagtccctcagataatcctgataatcagcaatacatgggtaccattgcattagattattcactaaagctgaaggcaggagtcaccagttctgcaagtcaactgtactaatgcatgtctctcaggcctcaaagtgaaactaggcaggtggatctgagcaggcaacagcatttgaaacagggaaaagttttatttaaaggaaaatggaatattcttaagggacatccttaaatgaggagtgagacacatattcagggacaccaactactgtatgtcagaaacaaagatggcacctcagacttttcctggctgaggcaaggggctgaagacaaagggttacagccaatatgcttgcaaaactgtgctagccgatcagccattagaatctaattattttagggtaagagaaggtagaatttcttcaagaaccacactgcttttcctggcatacttaggttcaaaaaagtatacatcatatataagcttgactatttttcatgattttatattttctttgtttttccccctagcttttgtactaaagtttcttttgaaattgccagtatatctcaggaaataagggaaagcattcattagacgtttgggctagagaaaaggagaggcactcatggaaactgtgcctggtgggaatcaagatgagaagaccctaagggggacagaaactcaggaagaaatgcatggccaagtttattcttccagtcaaaaccataatgacattgtatttgaactttccagggggctaaaatatattctcatttgctcacaaaaaagaagagttttatggtctctagaagcttcctgtcaccgaatgggtcaaattaatatttctactcattgttctaaaacagtgataaacaacagaacttactgtgatgatagagatgttctatatctgtgctgtctaatatggtagccactggctatgtgtggctatggggcacttggaatgtgggtagtgcacataagaaactgaatttatgtgaactcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccaagtctatatacagacctcagctctccttcttcatgcctaaagggtaaataccaccagacagattgcaaaaagacagtattatgtactaaagggacttagaaaacaaaagttggcttttagatttcattttcatctggatgagtctcaggtggagctaacaataggaagggaagggatattcaatccacttagaaatagcactccaaatcattgttgtccagtatggtggccagtaaccacatttggctactgagcacttgaaatgtggctagtccaaatggaaatgtacttaagtataaaaggcacacctgatttcaaaaccttagtatgaaaaaataatgtaaagtatctcattaatatattttttattgattacatgttgggaaattttgcatacattggattaaagaaaatatattatgaaaattaatttcaccttttaaaaactttatgtaactctaagaaattttaaatatggctcgtggctcatgttatatttctaataggcagtaatgctctagttgtagccttaactgggagttatttgtttattaattcgtaaagtgtttttccatggttgttttttggagagtgggagatgttataattttgtcttgattgttccaactaaaggccaactgagccaaaaatagcattgaattttaaaaggaaaaagtacaagatggtttcagatacctcccagatactaggtaatgaaacaagactaattttgccaagaacaaagatcaggccaccaagcaactttgtgtaacaaagagatttcctctcttggctattatttatgcctgtgacttttaaagatgaaaaggaaagttctctatctctgagtctctttgtacagtcttcacaacctaaaatgaaaaaatcgaagcataaatcctgcttgccactgcagaaaggtctattttaaattcccagcaagttcatcattttaaagaatgataaagtagcagatagttcactcataggcccaacacaactttttaatacatccttagagggtatggagtcaattgtattcctacttttgtcttctttagtgtttagcacagtgcttttgcacttagtaggccctctgaaataattttgtgcagttatgatcaacagctgggttcactttggccagattcaaagaactgcaaagctgtctgccaactccgtctctgtgggtctgtttttgcctcaataaatatttgttgagctaatgaaaatgtttgtctttccactgcatcttctcactcgtaagtgggagttgaacaatgagaacatatggacatggaggggaacaacacacactggggccagaaggggaatggggggcgaagggagtgagagcattaggacgaatagccaatgcatgcggggcttaaaacctagatgatgagttcataggtgcagcaaaccaccatggcacacatatacctaagtaataaacctgcacgtcctgcacttgtatcccagaacttaaagtaaaattaaaaaaataaaaaagaaaatgtttgtctttctagctatctctttcctctgtcctctgtatttacatgtgtatatacatgcctatcttgctcctcctgtgtctgtctttccctgtttttcctcagtgtgtcttcacatttttgtctttcacaatgacttgattggcctcaccacatctgattcctttattctctgggtatttgtgtgtgctgcatatctgtcttcttcaagcatgttggccttacattctactgcccattttcacacacaccccacaacccaaattgtcataatataaaatcaagatgtatttaagatataatctgccggcttaaatctatttactatgattttatcatttacttaatttactaattttatttttttgatcttagtagattgtttttcctcagttcttaattattaaagtaaagcaaaatattgacttttttctttctggaccaaaaaaaaaaaaaaaacccacctcccacttatattaactttctttttacttaaatggctttcaactgatttttttttcattaattactggcctaagttatataaactagtagtctctactctcaatatgtagagttttttaaaattaaatctgtgtttttaattgtttttgccttacctattattacagtgacattcaaaattgttgtcaataatcatttggtgttagggataatcagccccagtattttattctcagctccagagagcacaacagttcactcactctcaggagctggatttgagaagagcttctccattaatcaccttcatttacttggaaaactaaattttttctccagcatgggtttctgccatcccagcattcaggcctggggccagagaattgggctccatcttccataaatcaagttcagaatcacatgtctaatcgtttgaggccatatctgtgagttgaaggctaaaaatgacattgtttcactgggtttgctgtgaaaagtgttctataattggctaccaaatccagacattttgagcaaatttatgcaaagttaaaaaataaggaaagaaagaaaaaaagtcaggtaccccaaaattatcattaactcaacaacatgagtttgtcagaaatatatccggtgcgcacttgagaatcttcactttctagaatagttatataaaataacttgtttaataaatgaggtagagtgagacaacaaagtcaaatatttattttcagtcaacagctatcaatagcaaccctgtgtaattcctgaataagcaatagctatgtaacagagggctgaatttacaatgttggcagctgtcctcacagatttctcattaatgtatttgaattcatgttagggtctttccttaaatgagaatgcactgaaaaacaggcctttttttctctttcaggttcatattgtcttttctcttcaacattataatagaaaaatatttttgaggaagcagctcagaggatccagtttaacaagtatatttttaacatcaatgaacctttaatgagtgcctactatgtgtaatggagagtagcagttaagaatcaggttctcagagttcacagtgacctctatacttgtggtccccctgaatactggacatggagaagagttatatcaagaaataagatgaacacctacccccaataatgtacctttcctctatattttattcatacactcatcttcactgtcatctctcatatgaatcactctttggctggcctggtcctaattgaccttttctgtcttttgtttttctgaatcctacagattatatctgtgccggcatgtattcaccacttatatcttagcttgtctagacatgtaaaattgcttgaaactttgaggaatgtagaggaataaagggagaatttttgaaaaacttgaagaaaaagaaagagacaggattctgaactcagggctgtagaaaaattatttaatttctttaagcatcagttttctctttcatagtaagcagaatgcacgtatctcataaggttgtaaaaataaataagagaaggcatttaaagtccttagcacagtacatggcacatagttaattgctcagtaaatgctagttattattagggatgaaagacacactcatatgttgctattatatagaacagaatataataagtattgtgaagaaattacaaagatctctgtggacagagaggagggacaaattatttacagccaaggagtgggtatgatggattcttagaagagggtacacttgagagtgacattagagggtataggaatttaacaagtagggtttataagaagttttgtttgaatgcttacttcagactgtaggtttcattcactttggtatccctaaggtctgcaacactgccccagcatatatgctcaaatataaggtaacacaataagataattttaaaaagttttttgatgcacctgcatacataaactgttttatatatatatatatatatatagagagagagatatctgtatatctatatatctatatatatatatatatatatggttgaaagtctacttatgatgtttgttaatttactttcattttcatatttaaaaccacttatataaagtattattttgtagagatttttctactctcatatttcacgagtggtataattcaaaatcttcttatgtgtctttaacatcattctttttgtaatcactagagattatttttgagtcttccagcagttactcaaatatattacctgacttccatctaagatatttgagattttgaacccacatataattctgttcgtggatatttattcctagtcacaattacccattcatataacattaagactattgttttttgaatttgtcctgtaggtgtatatttaggtcttcatgacatatatctactatctactatatgactttttaaaatttctattacaaattgtcatacttacacaaaaatagggaaaataacacaggaactactgtattcttatcactcatattaaatatttatcaacaatttttaataaaatcacaatgccattacatctacaaacaattaacaattgcttcatatcatttaactcccagtctataatcagaattctccacttgcaacaaaacgctatttttataattgatttgttcaaatcaacatccaaaggagatctacatattgcatttgttgtatatcgtaagtctgtataccctgaagcagtctcctttctttttccactaccattatcttgttgaagaaactggttattgccttgtaaaatgtggcactttctgtatttgtctgttagtttcattagctgtcatttaacttgctcttctaacttccacctctgggattcaggggattctcttgcctcagcctctcgagtaactgggattacaggcgtgtgtcaccatgcccggctaattttgtatttttagtagatacggggtttcaccatgttggccaggctggtcttgaactcctgacctcaagtgatccacccacctcagcctcccaaagtgctgggattacatatgagagccaccatgcctggccagatgcttgcttttttaattgccagctttcattgtaaagagttagcatggagttacatacgaaagtgttcaatgaggggtattttgatatttttagtagggaaattttattaagtatctttataaagtcttacaattttacattgtcaatatgtttcactgagttgcatctattattgtttatggtggtcaaactattccatctttagctaatgggagaccctttcactgcattagttttgacagaggtcttttaatagcttgtttacgacatccaacacttgcagttatgtggtcataccctccaaaataacttattcacatcctttctttgtaattctgacaggtactctctatgagcatccaaaactagcattaattgagaagatatcaacctaatatgtcctttccaaactgtattttatagttaaaaataaatgaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtgaagatccttacaaataaaccattttatacaaagttatcattagaatagattcctaaaagtggaattgttatgtaaaaggatatgtgcatttttctttctgagttaccctccttagaggtttgtttatttaacacaccatcaataatgtatgagagtgccggtttgcctgcacctttgccaacacagctgtattcacttatttgggattatagtcgtataataaaaacactcccacactgacttttttaaaaaggaaaataaataagaaaggaactctaacaagaaagcatgtggcaaaacaaaaggctatcctgaagaattaattagccaatgtagtccatgtctttataatgccaaagtatctttgttacatgttatatctctccataggttagattagctatgcagctatgtttgacagaaagtgacaatgagagcatttcttgaaatcatttttctcttacacgtagatatatatctgggcaaaggaattttgtctaacatctggatctttgtcaatcatatcattatatagaatgatgatatgttcaattcatcaataattgctaacaaattttgctactagctcatgcgtaatcaagccctcagtcccccccgtctctctaaattagttttagttttaagactacagaaactaagtatataatgttaggtatttttcagacttatctctgctactcagtgagaagcccctttcttcttaatctaacatgaaagtctcatattgaagatgaatagctttgaaacttatttcttaaaagacttgttgaataacagtgtcgtttagagaacctgacaaagcagtgtatgccatggaactcagagtgctgagaataaaacctctgattttttttttttttttggttgttcaggaaactatgggcaagagtggtgtctagtgtgcttatagaagtgattctttgggtaggaccacccaccccaaaagtatttgcttcttcatcggatctattttgggccacacaaggtagaacgctgctatgaagcactaaatagatgtagtctgagttctataaaaggctttgtgatgtaggagattggaaatacattagcatttgtgaagaacaatgtttatggagcaatggaagatgctctttgttctacttaatgctcttaaatgcactgtgttgtgtgctgtcccttgtaaagaaagatgatgccactcaatcaaacaccattagcagagtttgcacgttaacttgttttttccagccacagtaatgagcttgttttaagccacctgcccccctttcctgtccaggcctcttgaatccaatggcacacactgtgaaacagctgcttagatttaatgttggagtgagtagccgagagttatctggcctttccagggattaagccttgtaattgtggcctcattatcactggactataacccaccgagctccctggccccacacccataatgtgttacagctctctttaaaattagatgaccgtgaatactctgagaaaagtcatgccctagctaaagaacagaaaattccgtgttctgatttataatcttagtaattaaagactataccatctggccccagctacattctgtgtacttagagcagtactgagataacatgatttttacataattttcttttttaaatttagggatgcattttttagaagtaaattacacaaaggaaaacgccagaactctgtctttggaaaagttattgcatgtgatggtaacatcattcctgagccccaaagaacacatctctcaacaaaacaagtaactatatggtagtatcaaactatatatatacagatatatatagatatataatctgtttttatgtcaggtgcgttagtatagtgagacaatatctagataggagcctacaagtagtaacttttttaatattcagcaaaagataaagtctatttctaaaaactaacagcagttcattttcagccacatgatcaatcttaattgagtcggcaaacagaacaacaacttgtgtgtggttataccaaaggaataaaacataccatgtcctggtacaaactaaatggcttgtggacaaagtgagtagaaaattaaaggcaagataaacattttggggaggcggcttagcataacaggtacaaacatgagctttgggaagtaccacacttgcacttagcactgaggtaaaaatgctaaagatctatagcaaaacatgaaatggtgattaagagcatgggctgtggagagaaagtaatgcatttttaagctcagctgctgattgtgcaaccttaggcaacctacttaacatttctttgtttcaatgtcctcatttgcaaagtgaggaaaatctaatttatctcatagagttgtacagggtgggcattaagtgagatcattacagagagctgcagagagtatggctcaataagtgaaatagcctttttatagcagcagcagcaataggaatacatgtaaaaaaaataaccattctatatggggtttaatccttgactatgacctcattagcaccagatttatatttgtaaaaccttaatgggaattttgcctatctttctggctccctcattcttattcctaccagattcttcttggacttcattgagcctttagacctcttgccctttttgttttctcccagtatatgagcttcttcctaggctcacttcttcacccttcttttcctctaatccatttccatgctgaaatcaaagtgacttatctaaattattagtcctaccatgttgctacttttacaactactcatgattatggcttgacattggcacttggtgggaaacatcaaaacctggtcaagattcctgataatgaaactgacctgctttatgaggaaaagggagaattgtgaattgtttctttctggacccttcaggctagatgccagtgtttccatttgagtagtaagcgcttggccatgtcagggagagactgttgacaaagcatctaatgtgatgccaagaacccagatgtacttatcgcattttaattgatgatgggtcccaatggttgagaaatctgttggtttagtattctttaatcatagtatagttaactgaaagatctctaacttcaagttaggagacctttgttacttacttgctatgttatcatgggcctatccttcctgctttctgggcttcagatttctcatttgtaatgaggaagttaaactggatgttctctattttcctttgagtcctgataatgcatgattactttgtactatctgagggattgagatttggaataaaaacaatacctatcataaaagcatgttcttcctacaggaatctggctttaatataactggaatggagtgataatagggatcaatgtaattaaatgtttagcataaaaatcaaattgacagtgttgcccattttagcacaccagacccaatacactggagaattaggaattttaacccctatctttgttagtttgagttttggcatctttacatcctatagtgctgcgtgacactgacttttttttttttaattatactttaagttctgggatacgtgtgcagaacgtgcaggtttgttacataggtatacacatgccatggtggtttgctgcacccatcaacccatcatctacgttaggtatttgtcctaatgctatccctcccctagccccccatcccccaacaggccccggtgtgtgatgttccccttcctgtgtccatgtgttctcattgttcaactcccacttatgagtgagaatatacgttgtttggttttctgttcctgtgttactttgctgagaacgatggtttccagcttcatccatgtccctgcaaaggacattaactcatcctttttatggctgcatagtactccatggtatatatgtgtcacattttcttaatccagtctatcattgatgggcatttgggttggttccaagactttgctattgtgaatagtgctgcaataaacgtacatgtacacgtgtctttatagtagaatgatttataaccctttgggtatatgcccagcaatgggattgctgggtcaaatgatatttctggttctagacccttgaggaatcaccacactgttttccacaatggttgaactaacttacactcccaccaatgatgtaaaagcattcctatttctccacatcccctccaacatctgttgtttcctggctttttaatgatcgccattctaactggcgtgagatggtatctcattgtgatttttgatttgcatttcttgaccagtgatgatgagctttttttagtatgtttgttgaccgcataaatgtcttcttttgagaagtgtctgttcatatcctttgctcactttttgatgggattgttttttttcttgtaaattttgtttaagttccttgtagattctggatattagccctttgtcacatggatcgattgcaaaaattttcttccattctgtaggttgcttgttgactctgatgatagtttattttgctgtgcagaagctctttagtttaattagattctatttgttaattttggcttttgcttccattgcttttggtgttttaatcatgaagtctttgcccgtgtctatctcctgaatggtattgcctaggttttcttctagggttttttatggttttaggttttatgtttaagtctttaatccatcttgagttaatttttatataaggtgtaaggaaggggttcagtttcagttttctgcatatggatagccagttttcccaacaccatttattaaatagggaatcctttccccattgctgttgtagatgtgtggcattacttctgaggcctctgttctattccattggtctatgtttctgttttggtaccagtaccatggtgttttggttactgtagccttgtagtatagtttgaagtcaggtaggatgatgcctccaggtttgttctttttgcttaggattgtcttggctatataaaatttcaggccaataccaatgatgaatattggtgcaaaaatccccaataaaatactggcaaactgaatccagcagcacagcaaaaagcttatccaccacaatcaagtcagcttcatccctgggatgcaaggctggttcaacatacaaaaatcaataaacgtaatccatcccttaaacagaaccaatgagaaaaacctgattatctcaatacatgcagaaaaggccttcagtaaaattcaacaccccttcatcctaaaaactctcaataaactaggtattgatggagcatatctcaaaatattaagagctatttatgacgaacccacagccaatatcatactgaatgggcaaaagctggaagcattccctttgaaaaccagcataagacaaggttgccctctctcaccactcctattcaacatagtgttggaagttctggccagggcaatcaggaaacagaaagaaataaagggtgttcaaataggaagagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaataatagagagccaaatcatgagtgaactcctatttacaattgctacaaaaagaataaaatacctaggaatgcaacttacaagggatgtgaatgacctcttcaaggagaactacaaaccactccttaagaaaacaagagaggacacaaacaaatggaaaaacattcaatgctcatgaataggaagaatcaatatcgtgaaaatgcccatactgcccaaagtaatttatagattcaatgctatccccatcaagctaccattgactttcttcacagaattagaaaaactactttatatttcatatggaaccaaaaaaagacaccaacttttaaaaattaaagtgaattaaggttttattttgtaaatatatgcatggagatattttgatataccccaggccgttgcaaagctcatctttgggaatcagcacaacatggttggcatgaagattgtttctttgggagtatacactactgtgcttcagttattacaaggagagtgcttcccaacttcaccaagatcccttcaattatttgtctttgtaaaccctgggttataaataattttgatgattgaactgtatttattaatagtttatttattgtactttattaagcaaaaaatacatataactgctaattaaagcttttaatcatcatgtgatatccaacataattacaagttgatataattctagctaaaaggaagtatatgtgatatttgaattagctgttctcaggtaattgtcaatttttttgttatgaattttgaaacatcaaatatcttgaaaactcccagatacttacagagcttccttatgattcacacactagaatttgagaatgtaatgaatatgttaggaaataatcaaccaaataataattatcattactgctaatatttattgggaaatcactgtatgccagaactatatacatttaatcctcctttaatcctaaatcacaaagaaactaaattacttacccagagtctgacaactaggaactagtagtacttgaaccaggggaggtttgaatgaatgggagtgaggactactgttctcaacccagcagtgagcaatgagagagctttaatagatgaatcttgaaggaagttgagatctcttgaaggagagattcatatttatacccgttgaattttaaattgttagaatatgtaaaagcatcagaactggggtgcagaaatatgttgggagtgctaagacagagctggggaaaaggtggtaaattttaatttgcaggttagtacctgaatttgtgcattcgagttgaaggttgtgcaaaggctagaagttgcacaaaccaataacttattggtcagagcagggagttccaaccacctaacaacatgtttggtttgaggggattggtaagtgtggtaggagaggatattaccattttatgacaagagaaccagggtacagggtagggaaatgcatatatatatatatatatatacacacattacacaattgcatatatggagtaagcggggaggggaggggaggagaaaggctcatttttagttagcagctggtgctctagagtttcaggatatttaaacctctgtggattagtaatttgtcgcaattttataccactggatgccataaatcccaggatattgagattccagggttagaactctagcaattttaatacaattaaatgctgagggtgctggaggacaaaaaaaaacaaaacccacgaatttgaaaggtaaagctctgaaaatgttaaacatgaatccccacttgcactccaagtcaatcacaattttagccctcaggacagtgggaatgggcttgggggttagggagacagaggtgttgaataacagaaagggcacctgggcaggtattttgggcccccctccctagctttaactggggcaactcccaatttatttgtttaatatattgagggtttcttcatacagtttcatttgataaaggcgttccaactttcaaagaaaagggtaaaaccacttccctagggggggagaaaggatgtggaacctctaaaacgtgttccaatagtttacctcagcctctgtccttttggaaataggggcagatgttagcaaggatgctttggctgggaggtttggatgggccaactaatagttcggtgtaccagtcatcccctactgtgaaaccaataacaacagcggcaacaacaaatgatgataatagcagctaccatatagacatcaactctgatctggcacagggctaaatgcttacatagattgtgccatgcacaatctctacatgtaattctctacagccctgtgaaataggaactattatctcattttgcagatactctcactcttttgcatctaaaggaattgtgcatgcggcctaaatacatgtgaataaaccagagtcacttttatttatttatttttaaattttattttagatttagggagtatatgtgcaggtatgttacctgggtatattgcataatgctgaggtttggggtacgaattatcccatcacccagaagtcagcatagtactcaacagttagtttttcaacccttaccctcctccctccttcctcactctagtagtccccagtgtctattgttgccagctttatgttcatgcgtacccaatgtttagctccagcttagaagtgagaacatgttgtatttggttttctattcctgcattagatcccttagaataatggcctccagctccatctatgttactgcaaaggacatgatctcattctttttatggttgcataatattccatggtgtacatgtaccacatttttctttatccaatccagcattcatgggcccataggttttttccatgtctttgctatcatgaatagtgctgcaatgaacatacaagtgcatgtgtctttttgataaagtgatttattttcttttggatacatacccagtaataggattgctgggtcaaatggtagttccgttttaagttctttgagaactctccaaactgctttccacagcggaagacctaatttacattccctccagcagggtataagtgttctcttttcttggcagccttgccaacatctgttgttttttgactctttaataattgccattctgactggtgagagatggtgtctctttgtggttttgatttgcatttctgtgatgattattgatgtggagcatttttttcatatgtttgctagctgtctgtatgtcaaaaggcatttttaaatcatattttgcaattagatttaagtagtttctcaggacttattgcggctgaaatatacaccaagtcgaggtgatctattcctttgaactcaaataagttcagaaggacaaatcacacaccgggctctgaagtcaggaatgtttgttcgcttattccaagagcaaagtgctttatttagatttaagtagaagaaatgttttcttcacagaaaggaaaagtcatattggcattgcatgtttgctttaaaagatttttattaatttgttcattcaacaaatatttattgggaactaactgtgagctctgagcccagaatctcacacttacagaagtgaggaaatgatttgtctgatataagcctcaagcctaagaaatttctagaattatcaaatcccggtttaggtggcacctattgattaagtgtgatttttcagcccagttccaatcgatatttagaaacacaagcagagtgaggagggtagtagagttgtagattataaatcatagaattaaagaaccttagaaataaagtagctcatttcctgtactttaaaagcaagagagtcagacagacacgggttgttaactgtgtaaccttgggcaggtaacctctctgaacctcagttcatcatatgtaacatgggaataatagcatctgccttataaaaatatggtaaggattacataagataaattatctaaagttcttagtgcagtgtctgacatatacaacatactcagtacatgtttactgttattgtgatacctgttttccatgtgaggggactgaaactcagtgaaaggaagtaactagcgcaaagtcacatagcttgatgatgttaggacaaatattagaactcagatctctactaatagtcaaatatgccttatactacacaccgagtttactccctgagagccaggtcatatacacttcctggacctgtgagaaatatttgggctaatacaaggagaagggaaaagaatgacaaggaagtgcctgacataagaaaataattcctggactcagaaaacaaaacagcaaggatgaaataaagaacaagagaaataattaccagaaagtttacaaagcaatgttggagtattataacatgtagtcaatcacaggactgatctctattctaactcctttattcactaaaagcgaaattgactttttttctttttcttgaaggtgttggtgggaggtggtttagaatgcatttgtgattcatagaaggttactgtgaatgcagcttactatacaatttctatttgcaaagcaagggaaccccataaatgaagttagaatggaagcaagagtactgctaagatataaagaatgatacattattaatttttttgagacatggactggctcattattaatttttttgagacaccaggctggagtgcagtggcacaatcacagctcactgcaacctcgacctcctgggctcaagtgatcctcccatctcagcctcctgaaaagcagggactacaggcatgtgccaccacacctggctaatttttaaatttttcatagagactggatctcaccgtggtgcccaggctggtctcaaacttctgggctcaagcaatcctcccgcctcagcctcccaaagttttggggttacaggtgtaagccactgcaccaggcccagaaatgacagattttaaaagaatattgggctggagtgacacctcaaagtagaagttgttgagaaatttagtaaaaataagaaaacaatggctcaataataaagtcatgttgctattgcttcatgtagctatagtacagtacagcactgagagagattggtctttagatgaagatagtcttaaaaattggaaatatatgaaaagaaccactcggtttctatactaaaagggaaggttaatttatacttgcctaagcaaaagatgatatattctttcctaaactattcttcagtttaatgaaaggcctgcaatgttggttattacaaaattcaagaaatatttaggggattccaggagtttcctaaaagaagcaaggccattttgctcaatttattactgcatagtgcatgacactcagactagtgccagaaaatctgactggagttcctagtccaccacaagggatacattgtgattgtttcaggtgcatatgctgtataaaaagattgttccaatactgtacacttaaaaatttgttaagagggtagatcgcctgtgtttttttttaatcacaataataatttttttaaaaggttgttccttttcttacctcataattttgagtttgctaattttcctcccctcaaaataattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaataaaaaaaaaagtggggggcatgtgtttgtggcacagggaaagagcttagtaaataaagaatgtgtatgtttcactctatgtcccccaaaatatgaatattcatgtttattataatgattgtaattcattcttgtattttaattgccattcaggtggccataaagcagatgaaccttcaacagcaacccaagaaggaattaattattaatgaaattctggtcatgagggaaaataagaaccctaatattgttaattatttagataggtaagtgttttgtcttattatgtacttatattctttgtgggatgtcattttttcttggcaaattactttatttgggattcgttcatttaacattctgcaaatatttctcaaatgctacagtgtagtagagtattagatctattgctaaacttgcactcacttagctttgtccacatatcagacacttgaagaaacattttatggtcttggttgtaaatttcattttgagaatcatagctccattttggcagaaaatagaccattgcatataggagggagtagtggtttaaacattacatcaagtgtttgtctggagccagtacaatttctgggagtctaagtgaagaaggctgactacaatggctttaatgggtgctttgtgattaactaacagtgaggtctagggaattcagactttaatctcaaacctttttcctaaacctggtaattaatgtctctttatcagtggtattaacagtgtgttataaataggtatttaaaggcagcactaactcttcacttgtggttaacatctgtctcattcaatttcaaaaagagtttgtttagtaccactgtgcggtgttctctggaggggatacaaagaaactaaatctaggtcttcaaactcaataagcttaagatactgttttctgctttttgggccaggtagaccaatgttacagaagaaggaaaaactgggaggaaaaaagagggttaaattttacagtccttttttttttttttttttttttacagagtcttgctctgtcgcccaggctagagtgcagtggcgtgatctcagctcactgcaacctctgcctcctacgttcaagcaattctcctgcctcagcctcccaaggagctgggattacaggcgtgtgtcaccatgcccagctaatttttcgtattttagtagagacggggtttcgccatgttggccaggctggtctcaaactcctggcctcaggtgattcacccaccttggcctcccaaagtgctgggattacaggcgtgagccactccacccggccgcaaattttacagtcttgatcagtgtctcctaaagtgtaacttaggaaccacctgcaacagagtaacctaaagtcattctgtgtttgtaattttgcaaaaacaaaaaacaaaaaacaaaaaacaaaaacaaaaaaaaacaaaaaaaacaatgcatttgcacttataaaaaattcagaattctaggctgctttccataaataataagatgaggactgtgaatttttgtttttaacaagctttccagatgaattttatggacaccacagtttgagcaccactggatagaaaatcttgcttcacattgatatgggtcttagggcagggtgggaacattgggttcattccatttcctataattcatctttcttgataagcaaggtttcagagagacctgattgtactgctaaagtgccgtcagatggtgtcaggtgatttgaataacctcatgctctctttgcctgaattatagggctctggtgacccttggctccatattatgatcacttggagtatgtccctcaataccttctcaaaggtaatgggcatagcacaactcagagttgacttctatcagaactgaggcctgggaatatcagagtccccaggttttttagcgtcataaggcaaagtcttttcttttcttgttatagctacttggtgggtgatgaactatgggtagtcatggaatacttggctggtggctctctgactgatgtggtcacagagacctgtatggatgaaggacagatagcagctgtctgcagagaggtaagcaaatagagcatttctagctgagaagaccaccgaaattggcagttcttcatttctgattattcagaatgtttgtatcatcaaagtaacaatagtagaacttttccactgaaaacaattggagaggccaacttcaatttaaattctgtcctaatagcactccccagcatcaccctcctgagcctcttgtttattttagctgccttttgtgaatcttttagttccattatgccatttgtgaggtgccgtatctaaacccacatgctgtagtttccgtgaacatgggaaacagtgatattggcatagcacttctttctaatttggggaagtttttacatgatacttattttatcctgcatgtgtaatatgagccatgtaaaataaattatattttcatcatttttagaaggcaatttaaacaaggtcctccctcaggccagaaagcagttgctttcacagtacaatctgaacttcccttacagcccccaagtgggcctgacggtctgtctcttttccagtaagtgtcatacccctaaggggtttcaaactaaattaaagagatgttattatatttattttgttgaatattaaaaaacacacacacttttttactggagtctcatcttaggcattataatctatcccatttattgtggtgaggttttctatcaacaaaagtaggaactctgactcactgaaacttgaaaaccaatgatagaaaaacaaaactaagtgatatcagctaatctctgctttttttttataagttgttcacttaaatttcctccttccttgctctcctctcattatcattttccccaccccacatatccaccaaacatatatgttttctattcattcaatacattaaacttactaccctgagcctgtggtttccttcttccagcattacactgcaaaggcatttccaaacaagtgcctatagttacttcatagcctaggagtggttcccaaacctggctacccattagaaatagtttggggcacttgttttaaatgcagattcctgggtttcatgccagaacttctgaatcaaatcatgccatctacaatgaagcttaccacagctatagaagaccaagctgaatcctccaaataactgggccaaagtatattaattggttaatttgactgtattattgattggtgctatttatcacattatcattcttaatgtcctagtctgatgtgtcagccatcatacttagcatgataatgctaagtggcatcattgatgtaaatggtaatgtgactttaaagtggtgttgttaaagcattcagtaatcgatttcacttgacaatataaagttatatccctgcccaaaatttatctagaaataaaacttagtattaaaaattatttgtgatataattagaacttttttttctgatttaatagtgcctgcaagctttggatttcctgcactcaaaccaggtgatccatagagatataaagagtgacaatattcttctcgggatggatggctctgttaaattgagtaggtattttggttcaggtggtattagagtatcagggaatttctgttctttcattgtatatcttaagaagataatggttactgaaagtgatttatttgaaagaagttacagcccagtttgaagtaaagaatttttctaacactgtgttcctgaatattgtgaccacattttttggatttaatatttcagaatttctagtgacttgtggaatgaataaatgacaaatacctaattaggaaactgaaaaattctgtaagtttgagaaaacagtgatgagagggaattagattgaagtctagtaaaaatgacatcacgttagtcaattatttcagaccttcttaaaatcaggaccagctgagacatcagttaacaaaaaggtatgagctaggcagttgtggaaactcagtgtgtagcaaaggaaggtacagccatatctgaaagtgatatattgtaaaaggaaaataatttgggcttattttaactggcttttcttctctgcagctgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggtaagtcagaagagaagtcaggtactttattcccaggaaagaggaaaggccaaatatcatttctggcttccaccaaaagtgaccagaatgggctcttttctgagaccagtaacatagaagcaccaagttataattttcaaatttactgtaagctttttaaagtttatcttacaatgtctcaacagttttccttgtctttttctttctttctttcttttttttttttttttttggagaaagaataactaccctttttttctctttttctcatttaattcttttttccttccaactttcattttaggtgcagggggtacatacgcaggtttattatataggtaaattccatgctgttggggttggtgtacagattatttcatctcccaggtaatgaatgtagtacccaacaggtagtttttaggtcctcagactcctcccaccctccactctcaagtaggccccagtgtcaattgtccccttctttgtgtctgtgtgtactcaatgtttagctcccacttacgagtgaacatgcaacatttggttttctgtttctacattaatttgcttagaataatggcctccagctgcatccatgttgctgtaaaggacatgatttcattcttttttatgtctacataatattctatggtgtatatgttccacatttttgttatccaatccactgttgatggacatctaaattaactccatgtctttgctactgtgaatagtgctgtgatgaacatacacgtgtgtatgtctttattgaaggacaatttatattcctttgattatatatccagtaatggtattgctgagttgaatgatttatattcctttgggtatatacccagtaatgggattgctgagttaaatgatttatattcctttgggtatatactcagtaatgggattgctgaattgaatgataactctaagttctttgagaaatctccaaactgctttttacagtggctgaactaatttacattccctccagcagtctataagcattcccttttctcctgaacctcgccagcatctgttattttttgactttttttttttgagacagagtcttgctctgttgcccaggctggagtgcaatggagtgatcatgatcttggctcactgcaacctctgcccactaggttcaagtgattagtgcctcagcctcccaagtagatgggattacaggcatgcaccaccatgcctggttaattttttatatttttggtaaagaagggcttcaccatgttggccaggctggcctcaaactcctggcctcaagtgattgacttgccttggcctcccaaagtgcttggattacaggcatgagccaccaaacctagcccctttttgactttttaataataaccattctgactggtgtaagatggtattcattgtggttttgatttgcattactctaatgattaatgatgtggagcattttttcatatgcttcttgggcacatgtatgtcttcttttcagaagtgtctgttcacgtcttttgtccattttttaatggggttgtttgatttttgcttattaattgagttccttatagaggctggatattagatcttcgtcagatgcatagtttgcaaatattttctccctttctgtaggttgtctgcttacactattgatagtttcttttgctgtgcagaagctcttcagttaaatgaagttccatgtgtcaatttttgtttttgttgaaattgcttttggagtcttcatcatgaaatctttgccagggcccatgcccagaatggtatttcctaggttttcttctagggtttttatagctttaggttttacatttaagtatgtaatccatcttgagttgatttttgcatatgatgaagggaaaggatccaatttcaatcttctgcatatggctagccagttatcccagcaccatttattgaataggtagtcctttccccactgtttattattgttgactttgtcaaaaatcaggtggttgtgggtgtgtgactttatttccgggttctctcacctgtcctattcatctatgtgtctattttttttttaccagtaccatgctgttttggttactgtaggcttgtagtacagtttaaagccaggtaatatgatgcctccatctttgttgtttttgcttggtattgctttgtctattggggcttttttggttcccagtgaattttagaatagtttattctaattctgtgaaaagtgtcattggtattttgatatgaacagtattgaatctgtacattactttgggcagtatggccatgttaaaaatattgattcttcctatccaagagcatggaaagtttttccatttgtttttgtcatctccagtttctttcatcagtgttttgtaattcttgttgtagagatctttcaccttcctggttagctgtattcctaggtattttattttttagggctgttgtgaatgggattgtgctattgatttggctcttaactggacatcgttggtgtatagaaatgctactaagttttttagcattgattttgtatcctgaaactttgctgaagttgtttgttagatttagaaggctttgggcagagactatgggttttctaggtatagaatcatatcatctgggaagagagatagtttgatttcttctcttcctatttggatgccttttatttctttctcttgcctgattactctggctagaacttctaacatttttctaacatgctttgattgtatttttaatgacaagggtctttaagattccttagtatagctttctaatgtaaaatacatgtagctttttttttaagtgagatgtggggagaaagtacttttattacatgacatggttaaatgatcaatctaaaaaacacttgctttataattactttaacaaagtaaataaatgcatttccagaacagctgtaatttttaaattggattttccttcattatcagtaatgatttattgattaacaacagcttggtgggtattgagtggaacacagagatagacatagtgccaacctggtgaaatcagaaacttaattagattgtcaagtagaaaatgattggaaacagtttccgtttggtaactcactttgctaccacaaaatcagagatttgatcttcatgtgatcttgttatccctgcaaagagaaaaacttcatttcacaacctaatcctatcatcttatttcggagatgtgctgttgatcatgaggaggaaaggaaagaggtatgaaagaaatgcttactcagtgcagaagtgagccataggtattttgttgtgtatagcccaacagtgagctattaatagaagctgtgttttgtgtctataacaggcatcacattgtttaaaaaagaaaatatgcacagattcaaattctactctcaaagttcaagcacagtgctagtatcataggcatcttgtatactgcctgcatcattaccactaggagtctaaaattgaattgtacccttggtatgccaaaaaaaaaaaccattgttcttagtaaatggttaagtgttttcatataaagcttgcaaaatccatgttcaaaccaaatatatgtggctttctatgcatgtaaagagacctataaactaactgtctagttgttttgcagttaaacattttgtatttgggaactgcattccctgtatatggagaggaggacagcttcctcctggctctctcctaactcctctctggtacttggcctcttgttttattccctgtgctgattagaaaacaacagatatgagggaatgccctaatgaatgctataggctatttctctgatctcatgcaacaatctggaaatgagatgtgcacattgattagctgccttcagggctgagtggaaaagaaggggcattttcccaccgtttgtgggttagccctccatggatttaatcaagtccacacctggcctatggtccagcgcatcaggataattacatgggcttttccttattgtttaaccaccttcacccattaagaaatagcagtgaaagaacacatcggacctcttgtttctatggatttcctcccctaagtctttggagtttggaggcactaaatggattatggctattttgctttctgccttctaatgagtaatttacagcctgcaaattttaaggattaaacaaatggctctgtaaaacaactagtctcagtaatggatttattaccttcttcaattccccaattacaattgatctctctttagctaggctgctaattattagaaaaaggaaacaagttttaatctttataggcatcttctagcctaggattagaactcacaattaacagcttgtatcttagatgccaccgcctgatatctaaacaagtacttgcagattaacaaaccacaaggttcaggaagcctacattaagtctgcaacaaaaagacctgtgagaaagaccaccctgttgaattccactgataaggatttactctaactttgctcattactctctgtatgtgtgatcaaccttcaattaatcaatcaacaagcccatacagagctagctttattctaattttgtctcttctaggcatcaggagtacttttttggtttcgatttcaaatatgttttcctaatgttctcttgaaggaaacacaatgtctcaggctatatgcccttatttggaatctttaaaatgtagtcgctgaaaccatggggagattggagagaaaaaggatctaacatgagcctatagggagcagcgatttcttggatcctggtgcccaggccatatgtggggaaatagaaaataatccagagctttaagaggagtataaaagagtgccagattagtcttctttaatatccttccaacactacaacacatccactattgtgtgctttgaggtggaaagaggtagaaggaaggaagtgaaataagtgtaagaaagacagagtagtagagtacagggtagcatgttgatgtgaaaaattttggtcctgtagtcaggcagatctgggtgtgtcctggctctacaacctgcaagctctgtgaccttctgcaagttacttaaaacctttctaagcctgcttcctatctgtaaaatgagaactatgtctatcttacagagttagcatgaaaactaaatgaataatatatgtaaatcacctagcacagtgtccagttcactgtaggaaaaaaatatatatgtatatatttatatatatgaaatgtatatatggatagtaaagtagtaagataggaaaaacagagaaaggatgtttagagggttttttttacccactcatgaagggaggttggattcagcactctcctaagaacatatccttcatgagagtggcacacccatctactcaaggaatggagggttttgcacagttcagtacaattaccatgaacaggtaacactgaacagaagaagttcaaggtgaagtctggggctatacatttcaaggtcatttatgtttcactgtgagtttttctgtgtctctgttgtatcagttccagctgagcagaccctttatgaatattgcctattaacatattgttaatgcaatgaattaactacttttccccttagttagaaagtggctgagattttttaatgtaaatgttgctatactaattgacctaatttgttcataaaatgccttttaaaggtcagagagttattaattgtactgatgttatgaggcttgtacccttccagagagagaggacacaagcttcttactgtcccccactgcctgaagtctttgtactcaacataattggccttggacatgttgttctgtgacctatagacagttttagtgcagcctccaataattaagtaccttgttccttctctttgccaaagtgactggggttaaaaatctaactttccctgtggatatacaaatcaaatgttactgttgctgatatcatcaacttttttgttaattgaagactttaaacaactgttattataataacttgatgctaagtaaggagacacaatcatttttgtcaaacaaaactttggtctattttctcagcacccagagagtgcccctttattaactttgcttttacacgtaatggggctattcttatcaacaggttttgatggaatttgttatttgtgaaatgtaaaaaaatgacatccacttgaagtccctactagactctttgaaacaccttttatggtaatgttccaaatctttatccaagttaaaatagattttaagtgttctctttctaccccttacttgaaacatctgtgaagctgtatcgaagattggatcgctggaagacagttattggtatcactgctaaaaacaatatgtagtatagtatgtgaaccacagatcctgtatcagtggatctccttggttgcacattggagtcatctgtggagctttaagaaccagcgattctaggcccccatcctcagggaaaaatggcaatcaggaaatgtcaaatatcaatgtggcaagccctttatagaacactgtccagcctggacaacaattcgtcatcacccctctttgaacatggtcgtccaaccaaaaaataacactatcattctactcacatttatccattttgtctaaaaacttatgagtaatactataaaagcctaattgaagtcctgatgtgctttatgtcattctctgatttaccagttgagtagcactatccaaaaagaaatgacattagttcagcatatgcctccatgatatgctattttcttttgcaattttgcttcttctgaaaatggagttcatcattaaaatgggctagctgctgaccgagtagctagcatatattggtgcataataaacccatcagtctgactactcatgattaggagtgcattacctatatggcaagggggaaaggaggacagaaatctaaaatcagacctcttatctacactagtaggcttcccacttcccttttcctgcacttaaagcactacagaaatgttagttgttcttatttcttcttgtgggaacagggaaattataattggcttatatggctagagaagagagttaagcagaataagagaatctctagtaactgaaaagcaactaaaggctaaactgtttctaaatccctccaagcactgggactttgctgtggattggaatgtctgggtttgatggcgtgtgctcatttggaattaaagtcagacataaacttcctgagtgccagagaagcaagcatactttgctagcactcagtcaatattgttttgaatgtatttcaggaagagctgggagcattcccttcattttccataagccatgatggaacagcaaggtttattgatggtttgttgacactcctcctattttgagggcaaacctatgcctaaaaggagggggaagttgggatcactacaactaaaataattacagaagaataacagggttcctttttaatcagaaaaaaatattgcctgtcaaaagatagacagctcttaagaatcattggttgttaggaattcagcataggaaaatgggacttagccataggaaagctgcaagtctcatttagaatgtaattcagaagcagacagctcaaactggtgaattatgacccagaaaacagccaaaggagaaattgattccatagcaaactaaaatccaccaagagaaaatgagagaaagaaagtttatgctactattatgttataatttctcagaatccttatagcatggcttgggagtaaaacaaggatgcatatgctgattgccctaataggtaccatacctataactaagtagttaagtccctccagatcaaagttaattctaaagagacaaatcatggagtgtgatgatcggcatttgcgcactgaaatgcccatgcacgtgttttatcctatggcttttgaaatctgtgtttttgccaatgaagaattattttaccaagaaagttggagttttcttaataattaagataatttctgacctttattgtcattttgattgataccttttccaaccgggttgcaacatcattgtagaaaaccctttgcattctaataaaacagtactctgaagtgtcttagataagacgctctgcagagaaagttaaatcaattaaggcagtgtaagaattgtagctgggagagtcagagttctaacattatcccaataatcaaactgacctttctgttgtagcttttttctttcttttcttttgctttatttttcttttcttctttcctttgctttgttttttttttttttttttgtaaagaattaccctcacgctcagatggcaaagttcatcagcacattttttttttttttttttttttaatctaggaggggccaatgactgtgagagatctagacaaggaactttctagtgtctctaccaactgttcgcattatgcgggttaaagagtgaattgtattccgatgtctgtcagtcaagaaatccataaccttgtgcaggtttcttcttgctgagcctacatttccttattgcttcaaaagagtggaatttcactagatttttgtttaccagtaggctccacaatgccctagaataccatagagttccttgagggtattgaaggagccaagagggaggtaaccaggatagggctcttggttccaccagaatagttcctttttaattccttttctgtcttgcgccatcacatgagattttcttaaataaggctaaaaactcgtgagtcccttactctgattctgtgtcctttagctgtacacagcctacagccttccccaactctgccaaaagggccatgttttgtgtgttgtctctatgagtctctatgagtactttcagaggagtggtattcagaaagcagcttggagacatttatctcatcatctctggagtaaatctgtatcccacagaatggaaaaatcctccttttcccaccaagcaaagacacttgatcatgatgtgaaatatactgtatatgagacttggtaacttcattctgataataatcttgggaagaagccagtgaagaacactgcagtaataaagctattgcagggacacaaggttcctcactctgtagtagtattaaaagaattgtatattattatgtacgggcctgttcagctgattaactgcatataaaaatagaagttgaaatcagtttatgtgactagtaatgcatgtttcacagatcatatcacagtcagcctgttttaatcctaatatggtaatttggaaaagcccaaaagaataagagtgctagtcccttcttgcactaatattctgaaatgaaacatgaacaaatgtataatattaaatattaccttaggactagaaatttgttgtgtgttaaagagaaaatgggaggtgaggaagttgataaaccaagtatacacagtattttgagaagttttgtgggaaaaggaccaggagcaatggagcagtcacagaatgggacctaggatccaggtccccttggtctcccagattgtctagcccttatctatcttcatttctctttgtcctcattccaccagcgatattctcctcccattgtcttttggcccctgtttttgccctaaagttttgttttgcttcctctgcttctcacagcttcttgcctctaccttttgcaccattttgctttccttcctttcctagctctgtacctacccacatccctacttccaaatgccctatagttccaaaccttgggtactgctttgagtgcccagggttgcttcataagcacaagcagccccctctgcaattcttagcaagcattattagttctgagaatgagcacacatattgttggagttatctgtaatttattttatggcattggtcagtcctttgtgcttgaaaggagcacatttaagctaggctaacagccagtgagtcagccctacctaattaccttttactatcaacctataaggggatagatctataataggttcattttaaatagccttttaaggattaaacaacaaaacaataacaattgtccctcataatttagtgaccagtgagaacttctatgtaagacaggtaggaagctaaattagaccacattgctcattcagctatcacactgaagttttgggttgagtaagcccaagtatggaatacagcgttcattataatgtgattatttctttttgtatatttggccctcattactctcttctaaaaaagacatggcagacactttcatgatatccataaacacatcagaggcagcaatatactctggcttttaaactgtgaaatcccaggtcacgagtaaactaagtcataaggtgttaagtcacttgttggcaaatatctctcataaaacactcaaagttagttggagattctaaaacaacaaaagaatcagattaggagtcagttgcaggcaacaaccagctgcatataaaccttcaatgtagatagatatatacgtgtgtgtgtgtgtgtgtgtgtgtgtatatatatatacatatatacatatacatatatgtatgtgtgtatatatacatatacatatttacatatatatgtgtgtatatatatacgtatatgtgtgtatatatatacacatatacatatacatatacacatacacacacatacatatatatacacacacacacagttgagcctctgatccacgggtgtgaaatccatggattcaaccaaccacaaatcaaaagcattttttaaaatgatggtttcattgtattaaacatgtacagactttttcttgtagttattcccaaaacaataaagtatgacaactacagtcatgtgctgcataacaatgttttggttaatgatggactgaatatacagtggtggtcccataagattataatggagctgaaaaatttctatcacctagtgatgtcataatatcctaattcaatgcattacttacatgtttgtagtgatgatggtataaacaaacctacttctcaagaagagcttcaggcaggtccttcaggaagtatttgcaagcaaggtattgttatcctaggaggtgacagcgccatacaagttattgcccctaaagtccttccagttggacaagatatagagaggggacaacagtggtattgatgatcctgacgctgtctaggcctaggctaatgtgtttgtttgtttcttagtttttggggaggttttgttttgttttgttttgagacagagtctcactttgttacccaggctggagtgcagttgtgctgtcttggctcactgcaacctccaacccccaggttcaagcaattctcatgtcccagcctccctagtagctgagattgcaggtgcctgccaccacactcagctaatttttgtatttgtagtagagacgaggtttcgccctgtggcccaggctggtctcgaactcctgacctcaggtgatccgcccgcctcggctcccaaagtgctggggttacaggcgtgagccaccacgcccagcctgtttgtgtcttagtttttaacaaaaaagtttgaaatgaaaaaaggaaaacatttttaagatagaaaatgtttatagtttataggataaggatatttaaaaaatatttttgtacagctgtacaatgtgttttaaactgttacaaaggagtcaaaaagttgaaaaaataagtttataaatttaaaaacttacagcaagctaatttattatcgaagaaagacaatttttaaataaatttagtgtagcctaagtgtacagtatttataaagcctatggcagtgtatagtaatgtcctaggctttcacattcactcactagtcactcagtgaccctgagcaacttctagtgctgcaagctccattcatagtgagtgccctacacaggtgtaccatgttttatcttttataccatatttttactgtactttttctatttttagatacacaaagacttaaacacactgcactagtcacctacagtattcaatacagtcacatgctgtacagatttatagcctaggagcaataggctgtaccatatagcctaggtgtgtagtaggctattcaatctaggtttgtgtaagtgcactctatgatgttcacaaaacgatgaaattgcctaatgatgcatttctcagaatgtattccccatcattaagcaatgcatggctgtatttacatggcatttacattgtattaggtaggtatcataaacaatccagagatgatttaaagtataggggaggctgtgcataggttttatatgaggaacttgagcatccatagatgttggtatctaaaggggttcctggaaccaatcccccatagataccgaggaatgacgtgtgtgtgtgtgtgtgtgtgtgtactagacagtgggcaatatacaatactgtatgaaacccctctacctctctgagtgggtacctgccctttgttccccatttccaaacaggtagagaatgattgacctcaagaggacccatttcttctgtacaggcagaggtggatcaattaaaccagtagcttatacacagtgtgcttcactccttgaaaagcccttgtctgccttttctaggagcactcccataacagagactgggaacagtgagacgtggtattgtgcagtggtcaagagcatgaactctggattcatactccctggattcaaatactagttgtgtgacattgggcaagttcttcttatctccacaagcctcagtttcttctcaattggagatcaaaatagaacttattataaacagtctaaaataaatttcaagggtttatatgtaaattgcacaagctaatagtatcattcagtaaaagttatctattaatactttccatggatataacatttatatagatatcaaggtatcaatgaatagccctcttatagttcagttgcattgtatgttaagtcgacttttagggctgggctggagccctgtcaccatgtatcatatgatttccatggtaaaatgtgttttgcatctcaaatattcagcctacaaagaaatgtttgtactgcaccctatcctctttgtaaagtgagtctttatattggtgctggggcccctcatggttgctaacacgtttccatgtaagtcctctggtttgttttctaatttcttaacttaaactttataaactgttgtaatgaactgaagtcacaaactaaagctttttaattaagtggttagtcctgttgcaaaactgccttaataacaatttattgagtacatatggattgtgtggggacttctttggagaaatgtggtaacttctatgatgactgctttgatcttttttaactgaggaaattgttaatatagtaaattgaattatcccttaaacttggtaacctagttttctcttagtacttaggtaaattcagttgcacatcagtgtcagtggaaactttgatgtttgtgtgttattaccaagatatttagagttattatgaagaattcgagaacatcagaaacttctaggtaatgcttatatcacaaggaagaaagccaccgtttttctggccaaaggttgtatttctaacattataaataaggtccgtaggttatggggcctatattgcctcacctcaggaagaaagcagatcttgttaaatgatctaatagattaatcaagagtaccttttctgttcaagaacagccagagagaataagtttctgaactatgtttcaagttccagagaacactttttttcttccctttctctatgggtctttctgcattggccatgttttagtcatctttttccagttttccctccctttggtgatgacatccccttacatacactattcatacagctctcttccttctcccacactgaacagtggggtcatcagaagttattacatgccaggcctgttcagctcagaaaaggtgctatttttcattttctgcatatcttcttagattttaataggtcacttttaggttctgagctttaatacttatgtatataagtctgttatagtctcagctcagttaaatttaaacattttggctattttgtccagcaacaaaaacatttattgatcacctattttgagcaagttgtcacaaaatccacagttggttataacacagctgctaccttccatgggctcacaatctaggaaggaagacagacctgtaaacaaataacaagtgttcatatataatacaatgtaaaaatagacatataaaccaagaactctcagagttcaaagaaggaaatggctaattccatctgcagggtgaccatagaactatcctggtttgcttgagattgagggacacaaaaccttcaatactaaaacccaggatagtccccagaaaaccagagtggttggtcaccatgtttacctatctaggagagatggagaagacttcaaagaggagatggcattttaaccagtgcttgaaaagcaagtttaccaggcacttaaggcaaatgaggatagcattttaggcagcaatgaaaggcatttcctattcagggaatgatgaacaaattggtgtgagtagtatgtgagcttcagccagtgtgtatgtgtgtggcggggcgggagaggagttgggagaagggccctagggtgagaagagaacagatggaaactggaactggaaaggtgggcagggggcaaatcatacaggactgcctaaggaatctttactatgtcctgtgaatcagtagttttcaaacaactataatgatcctctggttccagtgaaaccttgcttggaagcacaaataaatggagaaaaatgcacaaattttctgattgaaaaaggtatgtgggctggacgcggtggctcatgacctgcactttgggttgctgaggcaggtggatcatgaggtcaggagatcaagaccatcctggtcaacatggtgaaaccctgtctctactaaaaatgcaaaaattagctgggcatggtggtgggcgcctgtaatcccagctactcgggaggctgaggcaggagaattgcttgaacccaggaggtggagattgtagtgagccatgatcgcaccactacactccagtctggcaacagagcaagactttgtctcaaaaaaaaaaaaaaaaagaaagaaaatgtatgtgttggggagagtcttagagtatctcctcctctttctccctgttcttttccctcttaactgctcttaagaggaattttggggagcacagtttgaaaaccacctctgtggaccatggggagtgacaaaaaattttaaagcaggaagtgaatgacatgatgagacctgtgatgagataagattgttaaggaggatggactgaagaataaaaaagcttgaataatggaaaaacggttaggaggttattgtaactttggaaccatctgaaagaagcccgactttaagcaaagacaacagggatagagagaagtggatgggtatgaaagacatttctaaaggttgcattaatagaacctggtggactatttataataagggtgtggagcggggaagattgctgggtgaggaagaagggggaaaagatgattatatggtttcttacttaacattagaagcaaccaactagtatatgggaaatctgtagtctaatttctaatagccaccttattttctttgagttttcattagctcagataaaaccaacatgttatcactcacacccagaactattgtccttaatctttcttcatctaatacttgactttgctagtaaaaccctttttgttgtcattgttttattggctacaactgtatttgtctctcattagctgggtagtgggtagcaattttcttttttttactaagagagtccccagcttactcacaggatgtgttccaaaagtacatttttaagttaattatttggacctcagagtacattttcccatagaagtggcattatacatagtgattaggttcccaggccagtccacaaaagccagtttagcccatatataactgaaagtgtggatttttgcaatggaaattagttgtaaatgatactgttgcaattaaaatgaaaacaatagttgcaaaagaaatagtctgggtttttgtttccctcaaagagtagggcttgatgaaaagcaggtttaatcctaggaagacaaagagaaatagatggggatttttgtgtaaattggacactgcagctttttaactgtattttctaactaatgttttggaggttttaaaataataaaagcaactgtgtccattgtagaaaatttgagaaattaaagaatacatttcaaaaattaagtcaccaacaatcctaccatccagagagaaccagtattcacaaattggtgtgtttcagcctttttcttaccgcatgcattttttaatcagttcaccaatagtaattatggtgcatcgacatgatgaactattatgcagctcttaaaatgatatttatgaagaatttttaaaacatccaaaaatatttatgacatagtgttgagcaaaaggcaaccttgcatttgataccttgtttatggatgagggagtataagcagatcaacactaatcaaccagggcaggagtctgctgttaggccaccagtcagaacctcctactatcagacccaccccctaacaaaaactacagccagacctttttgttgaagttctgaggaggacataagggttctttgaagtactgtagaggttcgtagcactggctcttcattacttcagattttccttcaaattacagggctttcttctcccttgatgtactatttcactagcactactcaggcttaacaactgtgattaaggtcatttttttggattcataaatggaatggaaaaaaggccaagtatttccttaggtaattatgcatagattggagagagatgagaaggactcaggtagagaagatgtgtatgtactttcaaggaagaaaattatgtggaatagaatatattaagctaagaatggtgaaagtaaagtgagaaaatgagacattatagcatgaatacagatctacagagagcggaaacgagtctgggaaaggaagaaagaggtgtgcttgtttaggtctgggcttggctacagagcaggaaaaaaaggaagaacagtgactttggggaagttgtagccagctgaaatcaaagttttaggaggaggcagcgaatgcaatttgtagcaactgattttgttttaataaaggaataaagatgtttgggaggacaggtgcttcaagtactaatcatccaagaagaaaagcagtttgaacttaattgactatatctgctatgattgtgcactattcgattttagcccaatcagtgattttctaaaagcatcccatctccttttagtcaaaactggatttgtcactgacttgtatgttggcatggaggtcctaatagctgccacctgcatttcctgttcatcaatgaaggtattgaaaattacaaaggaatgagagttgggggaaaggaagatgttcatttcgtaggggtgagggatgtatttacatgtgggtttttaagtgtacagtactagaaggaaaagccaaaagtttccatgcattctagagaagcatatggcattgtaattctcacacattgctatgcaagacaatctcctatggaattctgtggctcttacctttggtgtacatacgacgcagagattctgagttattatgtgtgaattgggctccaggttctcagccagggattctcattgttggttgtaaattggaatcacctggagagcttaaaaatattggcacctaggttctgttcccagaggtttttacttaatttttctgggggtgagaactgagcatggggattttctaactctccccaagtgattctaatgttcagacaagtctgggactctctagtttagcccattgcttaattacttgggtggattaaactagttgttcttaaagtgttgtcctggaaccagcagcttcaacatcaacaggacacttattagaatgcaaattcttgggcccctgcccatatttactgaaactcttggggtggctcagaaacctgtgttttaacaaaccctctggatgattctgatgcatgctataaagttgacagccactagattaaacggttgttcctgaccctttctaaagtacatctgtgggagttgctaaaaacaagagatgtcttcaagagctgatgaaaactggcctgcaaaaggacttttacagaaatacctataataataataatagaagctagagtagagaaaggggaaaggggatgataatttgctgcaaaacctgggcaagttcagggggaacatgtcttcatgagttagggagtttgttgcatgggctagtaataccctggcagtacctgcaggcaaactcctacttattcttcaatacccttttaaaatgtcagcctcctctgtgaagctttctctgagctgtggtgtaaactacttcatccttgtgtttacttagtgctttctagtttcctcgattagctcttggcccactgtactgtagctctctatatatgtctgtctcccactaaactgcgtgatccttcaaagcaagaacactgtcttattcatccttagctctccagtgtctaataaactatctggtacatactaaatgctcttgaattgtttgcttagaggggggatcagtaatggccagctttcttgtatcaagaaccttcagctgggcgcagtggctcacacctgtaatcccagcactttgggagaccgaggtgggtggatcatttaagttcgggagttcaagaccagcctggccaacatgctgaaaccccatctctactaacatggtgacgcgtgcctgtaatcccagctactctggaggctgaggcgggagaatcacttgaacccaggaaggcggaggttgcagtgaactgagatcgtgccccgcactccagcctgggcaacagagcaagattccgtctcaaaaaaaaaaccttcaaaagatgggtttacctttgtgaattaatcgtagtcctgagttcaactctgactagaagactagagacattgattctctcaggccatcatgacttgatatctcttagtggtggccttataccacaaagctctcagagaaatatacaattattagcaacttattattttaccatgataattggcaggtgccaagactactattgtcattttttcctcatatttcctctcattgtagatgcaccttcatgggaaatctaattaaaatcaatagggatacagctgccacagggtaaaagtatttgagttcttgggccccacagcttgcctctctcatccaggcactggcatcttctggttcattgtacttccctaattctataatgtactctcttcattccacatctattcacaaacattcttcaaacaagataagcacttagcaaattacaattacctttccattgcactttcccaaggttatactcaggtcaaaatgaatggatgtatgtgtattccccaagtctttagagaaacagatttacaggcaatcctttggtttaattttctagatacttaatcacatattcgttatatgtgggtttttactggcttaactctcagaggacaaccatataaccttatttttaagtttttggaggtaggacgacacttcactgtcacctcagttactgccaatattaatcatttctaaatgttatagaaactttgaaatatatgtgtcattctctaaagtggaattattaagacccagaatgtaaaccagaagaaactggatttttgccgtctgtgccaagccatgattttaatatgtatgtgctgaatggatttttctatttttttctacaggcattgtatctgatagccactaatggaactccagagctccagaatcctgagagactgtcagctgtattccgtgactttttaaatcgctgtcttgagatggatgtggataggcgaggatctgccaaggagcttttgcaggtgaaaataaaataggacaattacaaagagaggcattatactcagcttttccatctcaatgtgtgacagagagctctgtcaagagatgtctagagttaggctattaccattttattttagaccacaggcacataactataggcacgcatctaatacatgattgattgacgtgttgcctttcttctgagaagttggcagtgtaatctgtaaatctcttttgttcttcctggagtcttattttgcaaggaaaaaaaaaaaagcaatgtgaccctctggtgttggtgttttgttctaaactttacttgtgcccctggatgttgtatgcaggtgctcttggccggaggtaattctctacataactatgcaattatttccatggcatttgctactctaatgctttgctggtcaaagcccctttgcttgtgatgccaattggcaggcacctgcttgcctgggtgagtaccatccagtggtgagtgcctctgtaaccatttgtccttttcacggctcccagggattagtatacatgatgagaaataatacttactatgtaccaaattctttcaataaattatttcatttttataacaactttatagggtaggcattattatcccattttatagatgtaaaagttgagactcacagctcttgaagggcagagctgggatatgagccctgaattgtctgactttccaccacacgtcacacacaaaccaatttagataaaaatatgtctgtatttgataaagcagtacgtgcccaggattatacacatagcttcactgctggggagtgtttctcagggacatgtatgaagacatttaacatctaagaacaatgactgctatttttctttgtgattttgaacacataagccaattaaacagaaggtgcaacacttggttatacagcgcattaaccacagattgtctgttctagcctactccctgaaagaaaaacctgttcctgttgcttctgaactccttccagagacagagctgcacccaggcaaaaactatcccaccctaactcagatcatacctggaataaacctatttggagaaactgaagagactacatcttttcttttctgctacctgcaagcatttcacaggttatcatagggccctaaaatgtcaaatctggaatggccctttgttaatcctctaattaatccagcctcaaattacagatgaaaagacaacttttgagtacatcacttttatattttttcacccctcccaccactccacatacacattctgatacacattcctcttatatcttcttgtaaggataattgaaggtgtaggttatcttcaattggctatccagataaatgtggctatccagctaaatagatcattaaatcaattatctagttaattcattccccaacaatacttttatatgaaccagtcagataactgatacaaaattgtattttgagtctaaattgaatagtttattgcgtcttttcattttatatatgtaagcaatagcctgtgtttctctttgagtccatgcaactccattctctgactctagcctattattgccattttcaagattagaaaggggagagatgcatgacattcaccccactggaaggctggagaaaagacacaggtcttcaatatttgtgtgtctttctgtatgacctaagacagttctgtccatcaattgatatttattgagcaacttccatttgtaaagcataagtgcagtgggtgatacaaacctattaaaaggcatgattcctccatttaagaagttcacaaccttcttaggtacatgaaaatataatgcaaagctgtttacagactcattcaacccaaagagctgttcaaatagtaaatgatatggttgattagagaaatacttctgttagctaggggtgatcagaaaatgtcttcaaacaggaaagaggtcttctgggccttaaagaagtgatcaggtttagttaagttgaagaaaataagggaagggatttcaaatggaaggaagtgttagggtataaccaaagacatatgggcaaggtctacaggaacagaacctagaaagtgtagctgaaataaagagttcaagtaaagaagctgcaggggataatcctatggtgggccttgaacaccaggcttaagagttggggctgtaggcagtggggaaacactgaagatgtctgagggacaagcatgatgacaactttgtttatgaagattaatctggtagtatgtggtaagaattagcaacaggaaaaaatggagacagggagaccaagggggagttattataatttgggattaagatgattaggattgaattagaaaaagcaagagatggccagacgtgattgctatgattgctatgcctgtaatcccaacactttgtgaggccgaggcaggcggatcacctgaggtcaggtgtttgagaccagcctggccaacatggtgaaatgctgcctctactaaaaatacaaaaattagccaggcatggtggcatgcgcctgtgatcctagctactcaggagactgaggcaagagaatcacttgaacctgggaggcggaagttgcagtgagctgagattgtgccactgcactccagcctgggcaacagagcaagagtccatctcaaataataataataataataataataataataataataataataataagcaagagataaatgtaagagacgttgagaagagagtacccggtagcttattgcatttagaacataaagaagaggaagacaaaagtgacttcaggctatcaagtcaatggtagcattcagcaagaggacaagtgatggaagacaatataatagctaacatttcttgaccctatgtaacttacaagggattgccacttacctcatttaaccattttaataaacagagatgaggatttaacctaagtgctctgactccaaagcccctgtagcttacattacacaagattgccctgcttgtgagactgtaacataactttttaaatgttgaatttaaggtgacagaagaaaatcccgtaggaaatatccagcaggaaaactaggaccagagttcaggaaagagatcaggtcatacactatggatttaggagtcatctccataaagctgatggtgggttgaaaccatgaaagagaatgacatctgtaagaaattaaattaaaaaaagaagatgatgacagccaagttcttatgagtgggaggtaggaggaggaagtgaaaccagggaagaaaatggagctggaatattcagtgcacatgcgcatggaagagacccaatatggtagaatgtcacaggcttctgaggcaaaaaaaataaattaaaaaaattcaaagaaggaagggatattcacttttattaagtactgcagaggggccaaaagagaaatggtagaggcacagccgttgggtttagcagttagtaagccattggtttcaggacagagttctctagtggttaactaaatatactttttccaagcatgacagcttctctagataaatatatcagtttaggaaaatcagagagtcagactgttgcaaacacagtgaggttttacaagatccctcagagtttctcactctgctagtcagcttccagaggatttcatgacaatgaagtacaaaaacatctgaaggacaaaagctggcaccgtttttaattaaatgatatttaattgggtgttcaaaatatatcttaattcaaaagggctgcttgaaaatgtaaagtaatatacttgttggaggaaagaattccaataattcctctttttccttccttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaacaaatgtgaaaagaaaatgaaacggtaatattaatttgaagcatactatgttatactttgcaaaaacgaatctgggcctgtaatttttaatgccacactgctctaatgagagagagaggccttaattttgatttcatttaaaaataagtactttaaaaaatttttcactcatagtgccgggaaattcaatgaaatcctgggatgcaaataaaaatcagtacattagtgactgtgtcctgccagtggagagagcccaatacctggttaggaagccctattcattagttagcatcccttacatgttgagaaggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaatgtcctgagttaggaatagggcagtgggaaagtcagggaagggtgagaagcacagtagagattatttatttaaaaaaggaaagaacgttaatgttgttagcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctcaaagatcgtgtaaataattatattcctttgctcaatgggtttatttctaatgaggctgccagttctgagagattctataatatcacttttaaataacataaacagggattacaactatgtaaaaagaaatgcatatggacaaagactgggaacacagataattgaaatcagttgtgttagggtggtggaattatgtgaatttttttttctttttaaaattttatttgatattgttataatattgctttacaataaataaacagcagaaagggaactatagacacatagaaaagatgccagaagcagatgccttctggccagagcgcagagcatgcagggcagagatatttgctagttacaattattccataggctttatgcttgcctgggtgctgaggttggcacacgctcgggtatggcacacgctttcttaggagactattatctataagttaaagctagggagatgtcactattagaactccaaacacactcttctgctttaaaacaggttgtctgccctctgctttggtatggcattcgggtgtctgttttgtggttgctttagattggaggggtgaccattttattagcccccttgataacatctgttgcagatattgcctttctggaacgttttaacagactctcaggttgaattttggaggactagaaggataaaatccccagctcccaccattttcttgtccaacaggatattactgtatatcattcaggtaggattcttcttttaataaccaatagggcaagtcccactaatttcaatagaagttatgacttgcaattaaaagctgactttgaaatcattaaacaaatatgtaggactgtctctgcctgttggcattcagttatagttctgttaattttggcttgggatggtctccatgtgcttttttctgcctatttataggttgtttgcagtagttgtgatttttaaagagcaagggagaccatctaaccaaaggataacttccttctaactcaccaaagaaattttaggtgagaactttaataatgaggtagtcacctcagatatgctgcttagtttcactaaaagcagaccctatacctagagaagtcactggctttttattggtcattctcaatacagaaatacttaggggagtcttaaccctgccatccccggttgaatctcttggtctttatctaagctacttgcagttaatattcagttaagcaaaggtatggccagtagtgcaagtatctcccagtctctgagctctgaacaagaggactgaaattcagcatttgtaaactgacagtttgatgggcctgggatttgaagtgaactcagcacacaattctgaacgtgtatttgcatgtggactgggaaggaaataaatgggaacttggaaataatggaatatttctcctatgaaagaatttttcgtagaagatttgtttttgatataatctttctgttggttagcttttagtgttttcattccttttctgatccacactcctttaagtgaccaaatgaatataacccaacatgcattgggaatgtgtttaatattaaacaatgtctaactgaatctgcaaatgcgggaactgagatatcacctccatgtgcacacctgtgtgtacgagtattctatacaacttgtagcatttactgccacttaattgggttgaacttgcaagataaacttttggaaactgcttagtgccatcggagtctcctttagaagctgccatcaggcaaatgctatcccataataccagcagtaagcctggcaacatgttcaacagatttagtacccaagaggaaatcaacagcgatagtagagaatgagtcagatgtagtgggataaatactagcctaggaagaaggagccccggagtctaatatgagctttattactaaattgctatgtgacgctaggcaagtcacttaacctctccatggctgtttcctcatctgtaaaataagtgtattggactagatgatccttagggtctttccaaaagtctaacattctatggcattataggttgccttgcaaattcagcctgctatagtgatggcaaatatcacgtttaagcctgagtctcttatgttgcagttaaataaaagaactatgtaagatgatttttaaaattcaagcaaatgggccgggtgcggtggctcatacctgtaatcccagcactttgggaggccaaggcaggcggatcacctgaggtcaggagttcgagaccagcctgaccaacatagagaaaccccatctctactaaaaatacaaaattagccgggtgtggtggcgggcgcctgtaatcccagctacttgggaggctgaggtgggagaatcgcttgaacccaggaggcggaggttgtggtgagctgagatcatgccattgcactccagcctcggcaacaagagtgaaacttcgtctccaaaaaaaaaaactcaagcaaatgaagttcataataataggggatgttgataaaacttgtggcagccttccaattcatttacagttgtttcgttttgtttttgttttaatgtccattttctgttgactgttcccagttttcattttccatacagtctgtatgtaaagtctggttttcattaagctgtggccagtatttgccactacaacagaaacacactgtcacacttgctagaatataactgtacttgagcttctcctttcctgtgaagtagtgctgggctttctagagtttaattctcaagtggcacaagatagcagagcccatgcattttaatggctgagactgctaagagtgaacctaaacacttacaagttgcagagagaaatgaaaaagtaattacatgctattagcattgagaaatgttgacaaattaatttgttgggaaccaaagatagcatttctgatgacaactcccacagtgattggccagttgtatgatgagtacactgctggaaagagggtaaactgggagttagtggatggtcccaatgccctgcctacagcagagtgccaaccagccctgagtgcaaaattcaagttcaatgtgtgtgcttgtgtgtggtgtgctttatggacccgcaaataccatattcattattgatgataagatcttcacagaatcctgtagctactaatgcattgagtttttaatctcagtacatcagccaggaggagccagatcacagggtagtgatgtctactgggattatactcataacatctacacaaaacaagttgagaaggatccacgttttcattgtttatcagaattgtatctcatttggctgagcattacttttgtcagaatgtgttatctgtaaaccatgtgtagtgaaattcttctgtaactttggattaaaggtatttatggtctttttgtttgtttgatttttaagtaagttatttcttttgtagacctgctgatggtatggttccatccttctgacctcagcatccaatctttttaaggatttttgttttcaatattgttattttaaattgtggttgaagcaatagaaaattgaaatatggattgtgcatgactgtgtcttgagtgtaaaaatattgcagtttgaaacttggacctaaagtattgcaaataaaaatgacaaacatcaa

SEQ ID NO: 908 - DNA, 30298 bp, mus musculus; identical to SEQ ID NO: 130

SEQ ID NO: 909 - DNA, 1071 bp, mus musculus
cgcccccagcttcgcgcccagatcgtcgcctatcctgcttgcgcagccgctatcgcgtctgcccaccgacgaagcatgggtgtccagggcttccaagagttcctggagaagcgctgtcccggggccgtggtgcccgtggacctcctaaaactcgcgcgcacggtctcgcgccagcagcagcagcagcacttgcaccgccagctgccgccgactgcagccctagcgcccggggctccacgcgccgccaggggctccgtgcctctgcaaccgccgcttccgcccgctgccttgggtgcctactccgggggcgcggggccgattcggcaccatcaccccgctcaccacttccaccatcatggccaagcgcagcccgggctgcaccctccgctgccgccgccgccgccccctcagctgcccggggcccgggtgctggtggacgccggctcggcgctgccgcggctctatggcggctaccagacggattgggtgtgtggcggccaatggaacgccatgctgggctacttgtcagcgctgtgccaggcttgtgcctatcctggcggcgacggcctggagctcgtggtcatgttcccggggggcctgggcaaggaccggctggccgagtggggccgtcggtgccaggccgagcggcagacagcgcaactgatcgtgggacacgtgggcaacaagggcacccctccaccgcgggcctggttcctgccaccggcctgcctgagccactgcgtgaggctagcactcatccgcttccgggtcaaggtgagggaggggccggatcttaaataataagccccacacctattccctcccaactaaatacctaaccacctacccacttacccactaccctacctcccatctacccacccacctacccgcccaacagctaacctacctgcctaactaccctctaccattttatccatttacctcccccttcataccaccccctacggattcactcacctacatggccatatctctactcatgtcatcccagtagctccctttagcttcccttatccaattggcctaccactaggtttcagcagaatc

SEQ ID NO: 910 - DNA, 107247 bp, mus musculus
cctccgccgcgctcacctcgcgagtccagccctcataagatggcggtcgccttggttgtctgggtagcgccgccactctcaacatggtagctgtttatcccgtatttctcctcccctctccgcctcaacttcctcattgttttgaataaactttattgactactccgaattgcctaccaccgccactgggcttctcccagcgacttttcgggccgtgtgcctcggacgtggcggccggttcatctctttccccgttggtttgctcgcgagtatctcctgccggcccagcgacgacgccacttgcccgttcgccgggcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggtaagacactacagacccttttaactgtaacattgttcattcctgtcaagatctgtgtcccttcccctccaatctgtttttgcatttcctctgtaaccatcttgggaatctcaggtgaaatgccttgtccaaagtcattctttggcagagatagagtcaaaatcctagtctcctctttgttctcctttcatgcattcactcattcgtttatcagagacagggtctcgccctgttgcccaggctggagtacagtggcgcaattaactcactgcagcctccacctcctcctgggctccagggatcctcaaacctcaacctcctgagtagctgagactacagggatgcaccaccatgcctagctagttttgtttattttttgtagagatgatgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctcccaaagtactaggattacaggcatgagccaccgcaccttgcctcgtgttcctttctcttcttcctggtggtttcttcctttgggatggcgagctgggttatattttctagggtagctgctcacgttgtaacagttgagtcatatttctcctccacagtttctagcattggatagattacatagtagctattttaattaatttttgtctcctttttcaagaccttaggacacccttctttgaccttttcctcctatatacaacagtgccacagtcactgtgtaactggtgggataggtcctcagttcctggaaatagatttactaaaattacccccatgtaggtttcttacatttaaaaagaaaaagagaaacctatttacctttaaatgattctatctggactcacacacacagtagatacgtatatagtcttctctttgggtcagaaatgtgggaaataccaagaaatcataatgtatctttttgcccttaggaaacttactgtctgattatttacatttttaacttttaatttgtagattgataggaagttgcaaaaaagtgtacagggaggtcctgtgtactctttagccactttccctcaatggtaacgtattatgtaattacggtacaatattaagacccttgctgttgtgttttttttttttttttttttttgagacggagtttcgctctgtcacccaggctggagtgcagtggcatgatctcggctcactgcaagctccgcctccctggttcacgccattctcctgcctcagcctcccgagtagctgggaccacaggcacctgcgaccacacccggctaattttttatgtttttagtagagacggggtttcactgtgttagccaggatggtctcgatctcctgacctcgtgatccacccacctcggcctcccaaagcgctgggattacaggtgtgagccaccgcgcccggcgctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctcacgcctgtaatcccagcactttgggaggccgaggcgggcggatcacgaggtcaggagattgagaccatcctggctaacacggtgaaaccccatctctactaaaaataaaaaaaattagccgggcttggtggcaggcgcctgtagtcccagctacttgggaggctgaggcaggagaatggcatgaacctgggaggtggagctttcagtgagccgagattgtgccactgcactccagcctgggcgacagaacgagattccatcttaaaaaaaaaaattgattcaaaaatgtttgacgaatcaaacgtttttgaataatagcagatgcctgaggttttcctggttgttaccttcttttttgttgttgttgaggcagagtaaaaacaaagattttatttatttatttgagatggagttttgctctgtcacctaagatgacagttgccagtgctggactgcagtggcgtgatctcagctcactgcaacctctgcctcccgggttcaggcgattcttctgcctcagcctcccaagtagctaggattataagcgcccaccaccacgcctagctaatttttgtatttttagtagagacggggtttcaccatgttggccaggctggtctcgaacgcctgacctgaagtgatctgcttgcctccacctcccaaagtgttgggattacagtcgtgagccactgcacccagccgttcttaccttcttaattgaaccagtttatactcatatcagcatgtatggaaatgtccacatttactttggaaattcctggtaacatgagaaacttccctttctccaacattattgaggtataatttatatactataaaattcatccattttaattgtacaatttgatgaattttgtcagttgtatatagtcatttaactgccaccacagtcaagataaaacctgtatgagaagtctttttaaagtcaggatttccatagtttcatttttagtaattgttacaattttgtaattagtgtattgtcagtgactatgaaggatttttgaggtctggaaaacaaatttcttaaatgattttggttttcaccattgttcagattatttagttttcttttttattattattatttttttcttagaaacagaatctgtctctgtcacccaagctggagtgtggtggtgcagtcataactcactgcagcctctcactcctgggctcaagggatcctcccacctcagcctcctgagtagctgggactataggtgcatgccatcactcccagctaattttttttaccttttttttttttttttttgagacagtctctcactttgtcacccaggctggagtgcagtggcatgatcatggctcactgcagcctcgacctgctgtgcttaagctgtcctcccacttcagcctcccaagtagctgggactacaggtgtgcaccaccacttctggctaattaaaaaaaattatttttgtagagactagctctcactatgttgcccaggctggtctcaaactcctgagctccagcagtcttcccaccttggccctcaaagtgctaggattacagacgtgagccactgtgtccagacaatttttttactttattttttgtagagacagagtcccactgtgttgcccaggctggactcgaactcctgggttcaagtgatcttcctgcctcaacctcccaaagtgctgagatttcaggcttgagccaacatgcctggcctagttttcttatcagaaaagtcaaaggaaagaatggaaaacttggattgtggctcttgtccaagtgatcacaagtccttacctagttgtttccattggtttatcatttaggaagtagaatgtgtaaatgaaagtgctattatgcaaatgttaggtttaactcttttattttaaaataatttcattttatagaaaagttaaaaaataatgggaagaatgtctgtctgcccttccctgagattcctcaaatgttaccattttattatattctctctctaaagcaaacacaataaaatggttatatatatatttttttcctgagacatttgtgcgtaaagacataatatttctttatatcttaataattcagttgtagttcttaactacaagtttgtcttaaaactttgtcttaaaaacaaagacaaagtcttaaataatttgtatagttatcaaaatcaggaagttaacattgatatactagtacctaatctacagacctgattcaaaattctccggttgtacacctgatatttctagtgttacttttctacattgaaatttattatcatgaaatactggttaaaccaatcatgctgtgagaatatatttgtgctactgggtttttgtttctttctttttttttttttttttttgccaaattatctttctggtgtttatccaggcaaaacacaattaggaaataaatgttcttccaaaagataatcacataacatataatcttccagaagtccttgggcgattactgaacttttaaacttttattagctttgattgcaggtgtgggaaggaacactctgtaaatggcatttgaaggcaaattcaattttcttctcatcagtaatgtggccttaaattctcctaaggctactagtattgatctactcatctgtagaggccattctttatttggcattgtgtctaaaataggaacacttggtgtacatatgtcttaacttgaacaattttgtttgaaatgccctttccaatttgtttttgtcaagtttatagaaacttaaaagtacaaaaagcaaagtgaccttttgaagttttccaaatccacaaagaaatgataattggatgggtttgggcaagaactctggcatattgccatcgttttggagcatgggagaaatacccctttggagtacccgttaaggacttttctggaaacccttggtatttttgtcacttcaacctctttttgtttcagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacaggtcttcccttgggtgcttctgggagggtttggggagggtggaaagaagaagggagcttttggccccacagcatattaatctgattacgtgggatgtctttctcatatcagcgaaaggcgcagaactgggcttcaagaaatttcatgtggtagtcagtgggcagcatggtcacctggggaggctgaaagtggggaatgtccaggaggaggctgatggacttctttgtcctgggttgatgtcatctgggtgaacagagaacatgactctaagccccgtaactctagggatagtgcctgggaggctggcattctaggctctaagtcagaatgacctgtggtggggatagtgctttttttccctaaacagtttgtacctgggcttcactcttagaattatgaattcttaggtcttgggtgggatctgagtatatttattgtgaaaaaatcccccagttgtctcaatttggggagagttgacatctttacttgattaggtcttatatgaatacagggtatctctccatttatttagattttctttgatttctttaatcagaattagtgttaaattttcttaaaatgtatagtagaattctctagtgcaatcacatatgcctggagatttgttttcttgggaagttttaaattaacattcaatttaaaaaatctttaaggttattcagattttctatttcatattaaataagttgcgatcatctgctcttcaaggaattggtctatttaatctaaattgtcaaatatatgtgtggagttgttcatagtgttttcttttttttgagatggagtttcactcttgtcacccaggctggagtgcagtgatgcgatctcgtctcactgtgaccactgcctgcatcccaggctcaagagattctcttgcctcagcctcctgggtagctgggattacaggcttgcactaccacgcccggctaatttttgtatttttagtagagatggggttttaccatgttggccatggctggtctcgaacttctgaccttgacctcaggtgatccacccgcctcagtctcccaaagcgctgggattataggcgtgagccaccgcacccagccatagtattttcttattacccttttgatgtcttccaagtctctagtggtattctttgtatcattcctgacgttagttatttgtgctttctcttttgtttgtgtcaattttctataggttggtcaattttattgatctttccaaagagccactttttttttttttttttttttttttttttttttttttctgagacagagtctcactctgtcacccaggctggagtgtagtggtgcgatcccggctcactgcaacctccgcctcccaggttcaggtgattctcttgcctcagcctcctgagtagctgggattacaggtgcctgctgccacgcctggctaatttttgtatttttggtagagttggggtttcaccgtgttggccaggatggtcttgatctcctgacctcatgatctgcctgccttggcctcccaaagtgctgggattacaggggtgagccaccgcacccggcccacttttggttttattgatttttctctgttgtctttttgttttcagttgtgttgatttctgcttttatctttatttttccttccctctgcttgctttgggtttattttgttctttttctagtcttgagatgagagcttagtttattgatttcaggctttccctaaatttccctctcagcattgatttaggtgtgtcacacaaatattgacatgttgtattttcattaagttaaatgaggttttgaaaaattgagatacatcttaaatattgtaaaatttaccattttaaagggtacaattcagttctttgtatatttacaaggttgtgcaacatcactgctatttaataccagagaatgttcattatgttatttatctcctttttgagatggagtctcactctgttacccaggctggagtgcagtggcacaatctcggcttactgcaacttccgcctcccgggttcaagtgattctcctgcctcagcctcccgagtagctgggactacaggcttgtgctaccacacccggctaatttttgtgtttttaatagagatggggtttcacccatgttggccaagctggtcttgaactcctgacctcaggtgatccacccgtctcagcctcccaaagtgctgggattacaggcgtgagccactgtgcccggcccgaatgttcattgttttttaaaaaaaccctatactcattagcagtcactctttattcatttgtctgccagcccttgacaacccctttttcacttcatttgtgtatggatttgcccttctgaatatttcatatagatggaatgttgtaatatgttgtcttttgtgtctagcttctttcacttgtaatgttttcaagaatcatccatgttacagcatttatcagtatgtccaggctggagtgcagtggcgcgatcttggctcactgcaacctctacctcccaagctgaagcgattctcctgcctcagcctcctgaatagctgggattacaggcacctgccaccactggcctgggtaatttttgtatttttagtagagatggggtttcaccatattggccaggctggtctcgaactcccaacctcaggtgatccacccacctaggcctcccagagtgctgggattacaggcgtgagctactcctgctccctggcgagtgcatctttttttttttttttttttttttgacggagtattgctctgttgccaggctggagtgcagtggtgcagtggcgcgatctccactcactgcaacctccgcctcccaggttcaagcgattctctggcctcagcctcccgcatagccgggactacaggcatgcgccaccatgcccagctaatttttgtgtttttagtagagacggggttttaccatgttggccaggatggtctcaatctgttgaccacgtgatctgtctgcctcagcctcccaaagtgctgggattacaggtgtgagccactgcgccgaccacttcgttctttttaacagctgaataatattctgtggtgtggatatgccacattttgtttatccattagtcagttgatagacatttgagttgtttgcactttttggctgttatgaatagtgttgctatgaacattcgtgtacgagttattgtgtgaacgtaagttttcatttctcttgggtatatatctaggaggggaattgctgagtcatatgtaactctgtgtttaactttttgaggaactgacaaactgttttcaaagcagctacatgtaccattttatattctcaacagtaatgtatgagaatttcagtgtcttcacatcttcccccaatgcttattgctgtctctttatgattatagccatcctaatgggcgtaaagtggtatctcattgaggttttgatttctgttttctggatgacctttgatgtttaacatctttccaaatgttcattggacacttgtatagttttttttggagaaatatctatttaaatcttttgcccattctttaattagattgtctcttcattgttgagttacaagaatttatatactttggatactagacttttaccagatatgtgatttgcaaatattttctctcattcttggggttgtcttgtcacttttttgatagtgtcctatgaaggacaaaagttacaaattttgatgcccaatttatctatttttttttctttatttgcttatgcttttggtgtctaagaggcttgcttaattcaaggtcatgaagatttatgcctatgttttcttctaagcattttatagttttagttcttacatttagatctttcatccattttgatttatattgattttgtgtatggtatgaggtaagggtccaatttctttcttttgtatgtagttctagttgtcccagaaccttttgaaaagactgttctttccccattgaattgtcttgacacctgtgtcaaaaatctgttgaccaaagataagggtttatttctggaccttgaattctattctgttgatccttctaacagtgtcacaccatctcaattattgtacatttgtagtaagttttgaaattgggaagtgccagtgctccaactttttctttttcaggattatttggccccttgaatttttttttttttttttttttgagatgaagttttgttcttgttgctgaggctggagtgcaatggttgcggtctcagctcactgcaacctcagcctcctgggttcaagcgattctcctgccttagcctcccgagtagctgggattacaggcacccgtcaccatgcccggctaattttttcgtatttgcagtagagacggggtttcaccatgttggctcagctggtctcgaactctagacctcaggtgatccacctgccttggcctcccaaagtgctgggattacaggcgtcagccacagggcccagccggtcccctgaattttcataagaattttttggttcagctttcatataggttttctagttattttgtagtgtttgctctaattattactttatacatacatagcatatcacagtctactagtatttacatattacctgtttgagggaagggttgaaaccatacctcttttttttgagacagaatctcattctgtcacccagcctggaatgcagtggtaagatgacagctcaccacagccttgacctcccaggctcaagcaatcctcccacctcagcctcccaagtagctgggaccacagatgtacactaccacgtctggctgatttttttagttttagtggagatggggttttgccatgttgcccaggctggtcttgaactcctgagctcaagtgatccacccacctcggcttcctaaagtgctgggattataggcgtgagtcaccgcaccgggcccaaaaccttacctctttttacatccctttatccttcgcatttttctacaattagtcatgttttacatttttccatgtatttgtcttaaatatttctcttcatacattgattatgagattgacgtgctacccactacaccaagagggctactatcctctgcgtatgttgagaactgtatcacaaagttttataatttttgctttccctatgaaacataatttagaaaactcaagagaaggaaattctatggtattcacccatgtttttactcatctgtttattctgttttcctttctggtctttagagtttcagggtaggtctactgtcgacaagttcttagtttttttccatcagtaaatgtcttgattttttttttctttcattcctgaaggatatttttctggatatagaactctgggttaatagttcttttctttcaacacctaaagaatgttttgctgtttcgttctggcctctgtggtttctgatgagattttggctatcatctgaattgtttttcccctatagataatgtatcatttcttgatgctttcattcttttttttttttttttttaagttttctgcagtttggccatgctgtgttttttttggtgtggatttctttgggtttataatgctgaatgtgttcactgagcttcttgaatgtgtaggtttatgtcttttgctgtatatgtgaaatttttagccattatttcttttcctttttttttcttttctttctttctttcttttttttttttgagagggagtgtcactctgttgctcaggctggagtgtagtggagcgatctcggctcactgcagtgtccgcctcccgagcagctgggattacaggcatgtgccaccatgccctgctaatttttgtatttttagtacagacagggtttcaccatattggccatgctggtcttgaactcctgacctcaggtgatctgcctgccttggcctcccaaagtgctgggattacaggcatgagccaccgcgccaggctgccattatttcttgaaatacttttttagactcatgctctaacttctgctggatctctgattacatgaatgttttgtatcttgtcttagtcccgcaagtccttgagtttatttttctgtgtcttttttctctttgttcaagttcagattgggtaatttcggtttctctgtctttgcattttctgtttctttcttctgttgtctccattcttctgttgagtttgtcaattgcattaattttagatacagtatttttttttttttgacacagagtttctctctagcacccaggctggagtgcagtggcgtgatctcaactcactgcaacctctgcctcctgggttccagtgattctcctgcctcagcctcccaagtagattacaggcacgcaccaccatgcccggctaatttttatatttttagtagagacagggtttcaccatgctgatcaggctggtctgaagctcctgacctcgtgatatacccacctcggcctcccaaagtgctgggattacaggcgtgagccaccacagctggcccagatacagtacttttcatttctaaaattttcttttgtttcttgtgtatttctttgctgagaatttctatttcctatttttgtgtcaagcatgtttggaattgctcactaaggtattcttatgatgatttcttatgatgatttctttcaaattcttgttacataattctatatttgtctaaccatatattgtcttatatatattggattgtctattgttttacaagtctgtttttctcttcaattatcaatattattgatacgatttcattggttttttagaatgtttaatacatggtgaggcaggtcattcactcccacccaactcccacccccatctgcttttctcttttatagttttctgttcccaggcatttattcatccatctttgaatcctttgcctggtctagtccataatgacttttctatactgggcatttagtaactgatggattgaatttgcccattagcggtttgagttaattaattgacatcttggtagaaatgcccacacaccgggtgcaatctacttagggccacaagcattgagtgtctactgtgtgccctggtattgggctaagtgctaaggacaaaagattgataggctgtttcagtataatattctactagccacaatagcaccaataggggtattcaccactagttttggaagcacagagaagagtgcttagtctagccataggtttgtgaaagtcttaggagagcaacactagaagggtgagtagggattaactatgaaaagaaagacaggaatggcatttcagacatagggaaaggtggaagaaaaccaaaactgtgtgaagcagcttatggatactagagcttaaagagcaagggctggggtggatgaaagtgaaaaggtaggccgactgaacttaccacagaggcgattgagggccattgaaggtttatttagtttctaatgaaatatttcagatgtaccaaaagatataaagaacaatataggccgggtgcagtggctcatgcctgtcgctgaggctggagtgcaatggtgcgatctcggctcactgcaacctctgcctcccgggttcaagtgattctcctgcctcagcctcccgagtagctgggattacaggtgcctgccaccatgcccagctagtttttgtatttttagtagagacggggtttcgccatgttggtcaggctggtctcaaactcctgacctcaggtgacccacccgcctcggcctcccaaaatgctgggattacaggcatgagccactgtgcctgaccctaatttatattttagatatatcgcttaggaatggatgtgaaggatagatttgagattattgtagagcagtggtttgcaaacagtcggtattcctttatactcttaaaaactattaaggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttcagattccccaactttgagaccatctgttggtatgtgggaaagcacatcctggacatctttcgcggtatggagccctttgccaactgtcctttttgcccctctcccctgagtgaatgagtatgtgtgtatgtgtaagtaacgcagtcaagacatgatactatttcattaccagaaagatctcagtatataaattaaaatcatgttgtgtaccgtaaatatgttcaatttttaaaaagtgataattagtgctttaaaaaaaatctccctagtgctacccgcccagccccgagccccttcttttttgagataggatttcactcagtcacccaggctggagtgcagtggtgtgatcatggctcactgcagcttcaaactcctgggctcaggcaatcctcctgcctcagtttgccgagtagctaagactacaggcatgggcccccacacctggataattttgtaaattttttgtatgaacagggtcttgttatgttgaccagattggtctcaaactcctggcctcgagtgattctcccacctcagactccttttgctggggttacaggcatgagccacagtacccagcaatgctacccctttatagtccctttatagtttcacccactctcctcccttgtaccatccgtaacttctggaaaccactaatctgttttccatttctataattttgtcatttcttttttctttttttccgagacacagtctcactcttgtcacccaggctggagtgcagtggcgtgatcttggctcactgcaacctccatctcctgggttcaagctttgcctacctcagccttctgagtagctgggattacagacacccgccaccacactcggctagtttttatactttttttttttctttttcttttttttgagatggagtctcgctctgtcaccaggctggagtgcagtggtgcagtctctgctcactgcaaactctgcctcctgggttcaagtgattcttctgcctcagcctccagagtagctgggactataggcacgcgccactgtgcccagctaatttttgtatttttagtagagacggggtttcaccatgttggccaggatggtctcaatctcttgacctcgtgatccgcccgcctcagtctcccaatgtgctgggattacaggcgtgagccaccacgcctggccaaatttgtcatttcaaaaatattgtataaatggaatcattatagtacgtgaccttcttagattcacttttttactcagcataatacatggcaaggcatggattttaacctttttgtttagcaagtgtgactgaaaatattggatcacagtgaaatgatctctatttcctgctggttaagataaaaagttcaatttggatagtctgagagtttcctggatctgcttcccctggggataaggcccagtcctgaccgtcctggcatcattgttttggttcctgggcgttagcccagttggaagccactttacttactgggtttcctctttccttgtctgatccagaatagaatgggtcccttacttaggcctgagattcttcaagttgacttggccaggagaaatcagtattgatgagttataaagaatctcaggggccatgagtacagcctcgtagccaatacctcaagctcttattctgccacctagactgtcacttaagtgttcaatcagatgctggatgactaactgctcattacttattctaaacagcttggttcagtagaaaattatttatagagcctaaatctggctgtttgtagtagcctcctgacataaggcagaacacagctaatccatcttctacattaatggcccttaaagtctgtgtaggtagagctcatagtcctcctgagtgttctcattttgaaacccaggaggcacagtaatgtcatggaaggggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagtcccaagtccttcactttcctgcatggctttgttgacactctgctttcctctttcctcctttaggtttgcgagagaacaggagacaccctgcctcctacctggtccatggtggcaaagccttgaacttggcctttagagcctggacaaggaaagaagtaaatatgcatatttctctacctcctctggagttttgccctttgtagggactggatttgggtagatgttttggagagacagaagagaccagagaagcttgtgggctcctgggtgtagagtggaggtgtgggctaggattcctttgattacattttaaaatctttctttctgatgataaaaagtaatacaacatcacactagagaattagaaaaatgaggaaaagcataaagaaggaaaattatcacctatgatttttacactcagcgggaactgctattaacacttgtgtacatttccttctggtcttttttatgtgcattttaaaaacataattactgtcacactgtgtggttgacccttgaacaatgtggaggttggggtgcagaccctgccccccaatgcagtcaaaaatccacatataacttttgcctccctaaaaccttaactgctaacagcctactgttgaccagaagccttaccagtaatatagtcaacacatattttgtatatgttatttgtgttgtatactgtattattacaataaagtaagctgaaaacatgtgtttactgttcataaagtggaaatgaatcctcataaagggcttcatccttgtcttcacatggagtaggctgaggaggaagaaaaaggagaggggttggtcttgctgtcccgggtggcccaggcagaagaaaatctgcatataaacggacccatacatttcaaacccatgttgttcaagggtcaactgtatatccagttttgtgtttgaatctattggtttgtcttaattttcctgtgtcaccaaagttctccagaaacatttaatagttatgtgatattcttttgcaggaatgtaccatccttgcctaactacttgcttattgctgcttcctttttatttctttgaggggatagttttaaagaatcagacagtaaatatcagtctttgtccctcatttcttgattgtttcttcaggatggattcctggaagaacaattactgaatcaaagtatatgaaaaaatgtaaggctcttgatgcatactgccaaagtgggttttagaaatgtacaaatgtccatttatccaactgaacattaatcaactataaaaaaaaataagaaagctctgtatgtactgatttggaaagatctccaaaatttgtcaaggtgcacaaccgtgtgtatagtgtgccactttatatgtaaaaaggggagaaataagaattatgttagtatatacttgcctggatatatgatctgggatgtagaaactaatgaaaatggttacctgtgggagtgggatgatgggattgatggcaggggcagggtgggattgatggcagggacagggtaggaatgaagcttttcaatatcattttattttattttattttattttatttatttatttatgagacagaacctcactctgtcgcccaggctggagtgcagtggcacgatctcagctcactgcagcctctgcctcccaggttcaagcgattctcgtgcctcagcctcctgagtagctgggattacaggcatgtgccaccacgcctggctaatttttgtatttttaatagagacggggtttcaccatgttggccaggctggtctcgaactcctgacctcaagtgatccatccacctcagcctcccaaagtgctgggattacaggcatgagccaccacacctggcctgcctttcttttctaatgtaagcctttagctgttaatttccttctcagcaccaatatttgatttttgacctatgtgaacgaattaacttttcagaatactgaatttaaaaaacacaccaagaaatcaagagaagaagaaatgtcaacatgtaatcttaggcttcagatactccctttcctgtgtatactgtgaccaaaggtcactgcactgcaggcttaacttgtacaatctccttagttcctgttgccaaccttcccctcggatattcttggatttcatattttgagccttcccttgctccctgggctcacctacacctggaccttagcctgtgattctgtttctccacacctctcaggtgtggctaccttgggtttcatctctgacacctcccatggagtgaactttagagtgactgtgtcccaaaaacaccaaaagggaggtgggtgtggcccaagcactcatgactcaggatggacccagggaccaagggatggccccaaacagagtgatcagtgggagctggagtagagtagaacacagttctgagaagcccatgctcatggaaggagtcttttgtgaagtgcagatgatttgtaggggaggaacctgctccctcacctttccagagaccctggtctgggaaggaggaagccataagattatttagctgggtcacatggattctcagctccccgcctagccaccaaaataaattccaccagatagatgaaaagagttaaagggaaaaaagagaattaaaccatgagaaacaaggaaatgctgaggaattttttatcagccctctggatacagaaatgaagtgaaaagtggtagaaaaaaaatcacaaaggaagaaaaccttgagatctacataaaaatgtaaatctcggtactcaaaaagagggcaaacgaaagagagacaactaacagggatcgctctgggttgctgttgagctagctgtgggccagcagctgctcagcacagagttctttcctcacaagtggagaggctggtttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttttctggtccatgcttatgtcctatctaagaaatctttgcctaactgaaggccacaaagaactcctcctctgtctaaagcaggggtttccagccggggtgcagtggctcacgcccgtaatcccagcactttggaaggccgaggcgggtggatcacctgaggtcaggagtttgagaccagcctggccaacatggcgaaaccccatctgcactaaaattacaaaaattagccgggcgtggtggtacgtgcttgtaatcccagctactggggaggctgaggcatgagaattgcttgaacccaggaggtgaaggtttcagtgagccgagaccaccacaccactgaactccagcctgggtggcagagtaagactctgtctcaagaaaatagtaagaagtaaataaaatatagcaagggtttccaaccttttggcttccctgggccaccttggaagaagaattgtcttgggccatacgtaacgatagctgatgagctaaaaaaaaaaaaaaaattacaaaaaatatcataggctgggtgcagtggctcatgcctgtaatcccagcactttggaggccaaggcgggtggatcacctgaggtcaggagttcgagaccagcctggccaacatggtgaaaccccgtatctactaaaaacacaaaaaattagctgggcgtagtggctcactctagtcccagctactgtggaggctgaggcaggagaatcgcttgaacccgggaggcgggggttgcagcaagccgagatggtaccattgcacttcagcctgggcaacaatagtgaaactccatctcaaaaaaaaaaaaagtctcataatgttttaagaaagtttgctaatttgtgttgagttgcattcaaagccatcttgggcagtgggttgggcaagcatggtctaaagggtgtatagttttaggttttacatttaggtctatgatccattttaagtttgtgtttgtgtgtatggtgcaagatagggattgaggtttgtttgtttttgtttttttttttgcatgtggatatccaattggtccagaatcatttgttgaaaagactactctttctccattgaattgccttggcatatttgtccaaaatcagttgtctctttatgtgtgggtttattcctcatgcctcttgtttgacaggctctgccagaccatgaggatgagatcccggagacagtgcgaaccgtacagctcattaaagatctggccagggagatccgcctggtggaagtaaggagcatggggcagggaagaaaaggcatttggaaaggccttgaggctcaagtggcaggttaggcctctgcagttagcatgagagcccaggggaagggtcgggaagaccctaccaaagacccaattcattcgttcaaataattattactgtgtttcaagtgtgccgcacattgggctaggctcttaaaatacgtaaatagtgcctgcccacaaagaactcagcctaatagaggaccctgagcaaagttaacctctttgagtttcagtttcctcatctctaaaatggggataattgtacctactcgaggattgttaaaaggattaaataaggtaatgtgggttgagcacaaaaatagagtgcttggcacacagtaggtgcacagtaaattctgacggtgggtcgtggtggtgggtggtggtggtagttgtagttgttgttattattaatattttgactcagtctctgcattctgcaaaatgacagttctctcggggtgaagatgattacaaagccatgtttcaacaggtggcatataccacgaggcagtaaggtatagtggtaagagattcagagaaacctgggttctggttcctgctctgtcacttgcaagcctttcagagcctcagtttcctcatctgtaaagtgaggataacatcaacctttcaggattttgttaggatcaaaagctaatatatgtagagcccctcgcacagtgcctggcagagtaagtactcaataaatgtgagccattgttattagtagactttaatagcaaagagagaagttggtgtgggatggtgaagtagcagaggcaccagaggagaattcctttaagctcagaagctgtaaagttttatttagtgcccaggatatatacatccatgctgaagggtggtcaaagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaaggtgggtgctggcccatgggttcagcccaacccttttgggtgtcccttggaagagcagggtttcaaaaagcaggctatcctgtctggctgccatgtcccttagaccccctgctgtttggctaccagtcccactcatttaataggcatttattgagaccttttctatgccgggcactgtgataggtgctgtggatgtgactctcaagaggctgacaggcgagtgagaaagacaggcataaaaacaaatgagtgcaatcaagtattgtgaatgccacaatcaggggtgtgtgtgggaccctgagatacagaggagggttgattctgtctgggtagggaagattttcaggagctcttttcagaaaacataacacttagctgaattttgaaatgctgggacgggaatgagatttgaaaacattgcgtgtgtcaggttgtagtcttgagcaggtccttgagaaaagccctccaccagggctccatcttgcctcaagattgtgattctctccatgggcatctgaagatgtgccccctcttttttaagggaacatggttcacaagattgacaggtgtcccctgaaccaaccacacattttcaacctcctgctcctgtgatcagtgggggtatggggggacagtatagcagaaggccttggctcaggtggttttgacagtgaactgaaccagtgaaaccagagggaacttgccatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccactgagacagggcatggaattggaatctaggggttgggacatgggtaggagggactgtacttagggcaatacctagatattataatgtattgttgcttagttcagagaaccatggtgtggtgttggaggtgggtagagtgagaggtctgaaatcgaattggcaagcctgagaaagattttatcagttctagaaacttcagcaagtcattgggagagaaccactggcagcaataagtatagcatacttactaaaagcattagttttttctataccttttgactttcgattagatttttaggaatttagtttacagaaatccttgcacacaagtgtgtaacgataaatgttcagtgttcactgcaccattgtttgtaatagtaattggaaacatccaaatgttcatcagtaagggctagataaataaatgatggtacatctatagaatggaatatcatgtagctgttaaaaagaatgagacagttaaatattgacacagaaagatgttcaaggtatatttttaaaatcaggttacataataatacataggaatagttccatttttacttttaaaagggcatgtatgcacatgtgtatatgtatgcacgtatggaaaagctgtatatagacatttgtattttttgaagaggtttaaaaatgcaatatacaagcgttagaaataaaacagtgtgaaagagcacacagtgaaaaatctcacacccatctctctttccctgttaccttcccatggacaaccaatgtcagtggtttccttccagagatatgtatgtacatttaggcaaataaatagtgtgttatatatatgtaaatacctttaaaaaaaaatagagatggggtctctgttattgcccaggctgagctctaactcctagactcaggtgatcctctcacttcagcctccagagtgctgggattacaggtgtgagccaccttgcctggcctagttatatattttatacttctcataccaagttttgttttttttttttttttttttttttgagacagagtctcactctgttaccaggctggaatgcagtggtgcgatctcagctcactgcaacctctgccctgctcggttcaagtgattctcgtgtctcagcctcccaaatagctgggactgcaggcgcatgccactatgcccagctaatttttgtatttttagtagagacagggtttccgcatgttggccaggctggtctcgaactcctggcctcgagtgatccgcccacctcggtctcccaaagtgctgggattacaggcatgagccaacatgcccggccttgttataccaagtttttaacagtggttatccctggaaagtacaatagggaaggtaagagcaaattttcacttcagtagcatttgaattttgtacaatgagcacgtatttacttttctttaaatatttatttacttttctttaaataattttaaaagaacaagttctaaaagaataaaataaaagctgtttacaacaaaattatggacttgggaatcaggcagtccgaggtttaaatcccagctgtgacacatattcagtgttctactttggcaaactaatgaacctatctgagcttcagtgtcctcattatatgtattctatagttaaaacttaccttagggttgttggaggattaaatgagataatatacgtagaacgttaaccacagggcctgccatataattaatacttaatacatggtagttcttataaatatgatgatgaagatagagacaaaagaattctccatgaagatggtgataatgatgtgggtatgaccagaatccaagaagattgtcagaaaccctgaaatacatagaggcaggggaaggcagtaagggctattttctagatactcagaacactagacatcagcagtcaagagccaagtgcagagtatgaacgatgtaggaacacaaacaacaaaggtagcttaattgcctccttgtaggaaaaggttaccttcaggtccatctgggcccatctgggtggaaaataagggaaaaaggagtgagagtagggcagattctgaaagcaacagagctattcttggggtttgagaatccagttactaaagtgtaagattagagagaccgttgaatattgcctttgtccagaactcatgataggtctcctggacaggagaaaattcagagtcctaggagtctagcctataatggctattgaaggtacaataagacatttcctgcccctgccccacccccagcagtccttcttgtgctgctgcctattacccgctgcagctgtcagaagctgttaagtgaacccagatagtcaaagtatagaaatatttacagatgatgtgatgctatgtctgggcttctctccaaacttggtgttttgaagagaatgaggtgtagatgaaacaagactggctgggttgataattgctgaaacttagctgagtgataggtatatgagaattaattctacttttatatttttgtgtatttgaaatttttctttaaaatttttttaaaaattattagagacagggtcttgctgtattgcctgggctcaagcagttctcttgcctcagcctcttgagttagctgatactacagacatgcactaccacaacccagctgaaatttttaattattagaagttaataaaagatcagggcatacatagctgtcatttattgagcatctcctctgtgtcaaagtctatcttagctgtttatatacactattttatttaatcctcacaaccccaaaagtaagtagtagtatccccattttactaaggtgaaaactgagagtcagagaaccttataatattacctacatggagcagttgccatggatcaagctctgtatgagctcatttaatcctcaaccctctgaagtagaaaataggtcagttaaatgacagacaattcactgaaagtcaatttaaccaaattactagttgctaaatgtatcaatttactgatttaccaaaaacatgtttctttttaactgtttatgaggtttttttcagcagtttgtattggttaatatcgtctactatgtgtaacaggattatctaagccactttttgagtcctgaacaaaggcagtgttcatttcaaccagcaatcatgagtgtcttcacttactggccaacgtttgttgttttttttttctttttgactgtagccattgaggtttttccagcagtttatattggttaatatcatctactatgtgtaacaagattatctaagccacttttgagttctggacaaaggcaatgttcatttcaaccagcaatcatgagtttcttcacttactggccaacatttgttattttttttttcttcttgactatagccattccggtggatgtaaagtggtaactcattgtatgtgttttttaaaaaataaaaattgtggcccggtgcagtggctcacagctgtaatcccaacactttgggaggccagggtgggcggatcacttgttaggagtttgagaccagcctggccaacatgacgaaacccttgtctctactaaaatcataaaaattagccagacatggtggtgggtgcctgtaatcccagctacttgggaggctgagacaggagaattgcttgaacctaggaggcgggaggttttagtgagccaagatcatgccactgtactccagcctgggcgacagagcaagactccatctcaaaaagaaaaaaaaaaaaagcaaatataaaaattgtctatatttaaggtatacaatgtgatatttgataaaatctatactgtgaaatgattatgccagtaaagctgattaacatatgcatcacttcacatacttaccatttttgtgtgtgtttgtggtgagaacacataggtctactctcttatgaaatttcaagtatacaatacagtattttttttttttttttgagacggagtcttgctgaggcaagagaattacttgaacctgagaggcggaggttgccgtgagctgagatcatgccattgaactccagcctgggtgacagagcgagactctgtctcagaaaaaaaaaaaaaaaaatttttttttggatacaaatcctttgccagataaacgatttccaaatattttctcccagtctgtggcttatattttattttcttaatggtttcttttgaaatacaaaaatttttaattttacttaatcccaggtcataatgatatttttctgtgttttactctagttttatagttttaggttttacatttagatctatgatgcattttaagttaatttttgtatatgatgtgagataagggtccacatttatttctttgtatccatttttctcagcaacttctactgaaaaaaaccatcctttccctcactgagctgctttagcaccttttgtcaaaaatcatttgatcataactgtacgggtttattcggaactcttttccactgctgtatgtctgtctttatgctggtattgcattgccttgattaccatagctttagagtaaattttggaattgagcagtataagtcatccaatgttctttttcaaaattattttggctgtgttaggtcctttctatgtccatgtacgttttactatcagctttttatttaaaaagctggctggattttgatagggattgtattgaatctgtaggtcaatgtagagagaattgcaatcttgctagcgactaacaatactgctagtgactgtttttatgttctccttcccttcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaagtgtgtgtctgttctttctttttcctcccctgcccgtttttttgtttgtttgttttgagacggagttttgctcttgttgcccaggctggagtgcaatggcacgatcttggctcactgcaacctccgcctcccgggttcaagtgattctcctgcctcagcctcctgagtagctgggattacaggcatgtgccaccatgcctggctaattttgtatttttagtagagatgggatttcactatgttcatcaggctggtctcgaactcctgacctcaggtgatccgcccatctcagcctcccaaagtgctgggattacaggtgcaagccaccacgcccagcccttgcccattttatatttgtttttggccctcttgatagacttaagaccttaggcctgagcttgttgacattttgctatactatgttctgtaggccttcattgtttcctttgttctaaagatttatttatcacctgatccctaacctctaaattagtcatctgtggtcattacttccaagaaaattagtcttatttttttcttctgggtatttggctgaaatgctaatcatagcttcataataagtgcattccattgttttctagaatttccccggaaattgccccgtgcgaagccttgctctgaccccaaccgagttcgtgaaccaggagaagttgagtttgacattgaggtaggattctgccctggatctagtcttctgctcattctggtgatagagacagaagacagattgtcattctagttgggggatatgcagggaggaagacatcctttgcattcatttcctgaataatttatttattattactattattttttgagacagagtctcctcgctctgttgcccaggctggggtacaatggcatgatcatggttcacagcagtcttgacctccggggccagctcagccttctagtagctgggaccacaggctcacaccaccaatgtagctaattctttaaaaaaaatttttttttgtagagatagggtctcgctgtgttgcccaggctggtctcaaactcctgggctcaagcgatcttttgccttggcctcccaaagtgctggaatcacagggtgagccactgcatacagtgaaatatttattaagtgaaagattgtgtgccaagtgctgctgagcatataaatggaagatttcaatttagttgaaataccttaaacatcctttaatacagaatagaatgaaagtcagtgtgggccgggcgtggtggctcacgcctgtaatcccagcactttgggaggctgaggtgggcgtatcatgaggtcaagagatcaagaccatcctggccaatatggtgaaaccctgtctctgctaaaaaattagctgggcgtggtggcacacccctgtagtcccagctacttgggaggctgaggccgaagaatcgcttgaacccaggaggcagaggttgcagcgagccgagatcgtgccactgcactccagcctggcgacagaacgaggctctgtctgaaaacaaaaaataaaaagtcagtgcgatgtagcagaaagagtatgtgatatggagtatctgatgtgaccttacacaaattatttaacttccctgagccttagttttcttatctgtttaaaatgggagtatactacctagctcacaaagatgccttggaaattaagataaaagaatgaatattctgcttagtacttggtctatacttggtgctcagaagatattaatatcaggagtcagatcatcgcccctgtactggggccttaccagaccaatcctgggcagctgaggtgatacactctctctccaacaggaggactatacaacagatgaggacatggtggaaggggttgaaggcaagcttgggaatggtagtggcgctggtggcattcttgatctgctcaaggccagcaggcaggtggggggacctgactatgctgccctcacgtgagtactggcttttatctcccctttccaggctatcagacagcaacccccgctcccgcccaaggtgccaggtcagccaatcagtagatatttatagagctatttaaagggacaaagaattatccagggcatttgggtgaaagaataaagtaggcatgaaaccactcctaaggaacttaagatctgatggcaataagatgtatagacttcaagaggaatcaattttgggcacttaggaagttgggaagaggggctggaagagtcaagcaaggagaattgttacaaaaacaatgaaaggaaagaatgcagcatgcctaaacagggagggaagtgtgccccttttttgccaccttgcctgctgtctgtggagagacaacacaaaaaggactggcttttcgtgaaagcaatctatgatactgtcttgatccttaaacttaattccaaatttttcactttggatgattctcccctttttcctcccactttgatcctcatagctatcatccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatagtaagggcagctaagcacatgggttcaggccagaaggggtctcctcagtcccagtctccatcctagtcccaatagaggacagcttgtagtgaacaaagtcctggtcttaagcctgatacttagtttctctaagccatattttcctaatttgtaaaatgggaatatctcacaggttaatgttaagaatttgagattatgctcacacagatcatctggcacagtttcttgctcatgggaagccttcaaaaaatggtagttataatttgctatcatctatttttactaatgtccaacctttaccgctggtgactctttttttctcttgcctgtttgactgccatcatctgtgtcatttgtgtcctgcgttggccagtttgtcccttgcagagatacataatgacctttcagtgagctttttacatttaagagatgactcctttttttaatccaagattttattgagtaccacagtgtatcaggcactcttgtgtaatacaggtgactgtataatgtaagtgctttttgttttgttttgttttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgttgggatgttttgtttttcttattgatttgtaagagttccttatatattctagatgtgttggagtattttttgtatattctggatttattgaaaaatatttccttttaggtttgtgtttaattttattatgtctttctagcatgtagatgattttgatttttacattgtcatctttatcaatttttttttttttttttgagacacagtctcactctgtctcccaggctggagtgcagtggcgcaatcatggctcactgcagcctcagacctctgcagtcccacctcaacctccctggtagctgggaccataggtgcataccaccacacccagcttattttttgtacagatggggtttcgccatgttgcccaggctggtctcaaactcctgggctcaagtggtcctcctgccttggtctcccaaagtgctgggattataggcgtgagccactgcatccagccatctttatcagtttttaatagttttttgtattttatgttttgattaagaaggccttcttatattttcccctaaaacttgtataggagttaaaattttagctctttatctggaattaagtttttgtgaattgtgggaggttagaatctaactttatttttttccacatcagtagtcatttcccccagcaccatttattgactaattcatcattatccccctgacttgaagttctacctttgtcataaacgaaattcccatatatatggggatttgttttccactttagtccaagttctgtaccttaatagctatatgaccttggtcaggctagttaacctctctatgcctctctgtgatagtcatacctacctcataggttgttatgagagttaaataaatatacagaaagcacttaaaacattgcccagcacatgataagtaagtactgtgtattagatattattaatattattctgttccataaaatcaacttgtcaaaacaaatttttattttaccaaacagatgctaaaaaagaaaatgaaaatcaacttgtctattcctgtgacaataccatgtaggttagttaccacagactttgtttctggtagagcaaatcccctctgcagaccttgctgtgaacctgaggagaccacagatgctcaccaaggctctcatctttgagctaagctttgatttgttttagggacatgccaggttcccctggccacccactctactgtgagcagtcaaatcacattgacctgcagctaagatgtctggacttgatttaaccgctcctcttagaacagctcactcagcctctcctccctccttcgcctccctactttgcccagcaaccatggaaaggcagcttaccaaggagagacctccctactttttcttatttttccagaatttcgaggctgctgttgagctttttctattccagatggattttagaatcagcttttcaaaggattgcatggtgtttgtggattaatttatggagacctatctttcatcagaggcatttcggctatactgggatttgcgcattcctgaatataacctcatgtcctgaaaatttgtgcactaaaaacaataaggcaggcaaaaagagattagggccacagccctcaaaatctatgtgactttgaagccaaaatacagactcaaataatagcagttctaagttagagcccaatggcatttgtacccggcattatagtcagtggcttctctatggccttaagctctggactcagacttcctctttccaaatctggattcttttgagggcatttggttaaatagataccagcttcatcaaatcaaaatctgatccagggcctagtccctatcaatcttttttggcaaaacaaacaaacaaaaaaaaaacagagggaaatgtctttgcaacttctttatctgctctgtcaggtagcctatcccatcagaactaaattttgtagaaaatagtcaccatttattttttctctggtaggcaaacttgtgtgatttttaatttttgtctgtatgtcttcttatgttgctaaggctttctctgtagttgtgaaaaagtctaccactgattggttgtaaacaactatggaaaattgtttttgaactggtacaacttctgaacagcattgaaatcattgttttgtctttttgttgttgtttgtttgtttgttttgagaccgagtctcactttgtcgcccagggtggaatgaagtggcgtgatctgggctcactgcaatctctgccttcctggttcaaacagttctcctgccttggcctcccaagtagctgggattacaggcacacgccaccacgcctggctaattttttgtgtttttagtagagacagggtttcaccacgttggccaggccggtcttgaactcctgacctcaagtgatccacccgcctcagcctcccagagtgctgggattacaggcgcgagccaccaggcccagccagacatctttctcttatttaccttttgggtatgagcagcagccatcttttgtttctgtcttcaaacatagtctgtctctatttattcaggtcttcttgtatgtatctcttctttggtttatttcttcttcagtttatttctagaaattttattttggttcgtaaaattggcatctttttatgtattacgttttctaattggctattgctaatacggaggacagtagttgattctttcccatatcaatcctgtattggactaccttattatactgttattagttctatttgttttcagtttattgtcttgagttgttgaggtagatgatctgtgtgtcctgtattagtttgatagggctatcataacaaaatatcacagactgggtggcttaaacaacagaaagttatttccttacacttttggcagctgaaagttgaagatcaaggtgctggcagagttggtttttcctgaggtctctctgcttggcttgcagatggccttcgtcttgctgcctcttcatgtggtcatacttctgtgcatatacgcccatgacgtctctctgtatgtcctaatcaccacctcttataagaccaccagtcagattggtttagggcctactctaatggtctcattttaacttaattatttcttaaaaggctctatctctaaatatagttacattctgaatactaggggtaggtcttcaccatatgaattttaggggacaccattcaacccataatatcctcctcctctccagtattcatacctctagcttccagttttattacagtgttgagtcatagtggtgatgggggcatccttgtgctgttttcagactttaaagggaatactgccagtctttctccactcaatatataggtctctgttagactactctcatagagttcaggggagtctctagctatttatttacttatttagacacagtctcgctctatcacccaggctggagtgtagtggcgcaattttggctcaccgtagcctccacctcctgggctcaagtgatccttctacctcagcctcccgagtagctgggactgcaggtgcacgccaccactcctggttaatttttgtgtttttagtggaaacagggttttgccatgttgtccaggctagctttactttaaaagatttttttttgttttaaaatcaagaatcaaattaggttttaccaaataattttggcatatttggacataaatacatagtttttctatgttaatttgttaatacagtgaatgacattaataaaattactaattttgaatcgatattttcttgagattagctgtacttgtacttggttgtggtgtttaacaatagttcatctagtttatttgattgctagtcttttcaaaaactagttttttggctttattgatcatctctagtgtttgatattttattctctttttaatttttctgtattcaacatcttgagttgaaagctctgttgatgtattttcaatctgctttttggtaaagcgttttttaaattttatttttattttatttatttatttttgagacagagtctcgctctgtcacccaggctggggtgcagtggtgcaatctcggctcactgcaacctccgcctccccggttcaagcgattcttctgcctcagcctcctaagtagctgggattacaggtgtacgccaccacgcctggctaattttgtgtatttttagttgagacaggacttcaacatattggccaggctggtctcaaactcctgacctcaggtgatccacccgcctcagcctcccaaagtgctgggattataggcgtgacccactgtgcctggcctgaaattttattttttaaattaacatgaagtaaaattgactctcttggtatacacatgtttatattcttccagccaccataatcaggatacagagccctttgatcactccctaacctcctttgtgttactaccccctttgtagtcatgccttccctctactcccgagcaaccactgatctgctctctgtcactgtggtttttgcctttgccagaatgtcatataaatggaattatgcagtatgtaatattttgagactggtatcttttgcttaccataatgccttttttttttttttttttgagatggagcctcgcactgtcgcctgggctggagggcaatggcgtgatcttggctcactgcaacctctgccttccggattcacgtgaatctcctgcctcagcctcctgagtagctgggattaaaggcgcacaccaccacacctagctaattttttgtatttttagtagagacggggtttcactatgttggccagactggtctcgatctcctgacctcgtgatccgcccgcctcagcctcccaaagtgctgggattacaggcataagccactgcacccggcccaccataatggctttaatattcattcatgttgttgcatatcaaaagcttgttcttttttattgctgagtaatattccattgtatggattatacccattgaaggtcatttcagttgtttccactttggggtgattacaaatagagctgctgtgaacattcaggtataggttcttgtgtgaatatgagttttcatttttctagggtaaatacctaggaatgggattcctgggcggtatgggcagtgggtgttttaactttacaggaaaccactggctgggtgtggtggctcgtgcctgtaatcccagcactttgggaggccaaggcgggcacatcacgaggtcaggagttcgagaccagcctggccaatatggtcaaaccctgtctctactaaaaatacaaaaaatttagccaggtgtggtggcatgtgcctgtagtcccagctactcaggaggctgaggcagaagaattgcttcaacctgggaggtggaggttgcagtgaaccgagattgcatcactgcactccagcctggggggacagagtgagactccatctcaaaaaaaaaaaaaaaaaggccgggcgcagtggctgacgcctgtaatcccagcactttgggaggccgaggtgggtggatcacgaggtcaggagattgagaccatcctggctaacacggtgaaaccccgtctctactaaaaatacaaaaaattagccgggcgtggtgtcgggcgcctgtagtcccagctactcaggaggctgaggcaggagaatggcgtgaacccaggagtcggagcttgcagtgagccgagatcgcaccactgcactccagcccgggcaacagagcgagactctgtctcagaaaaaaaaaaaaaagctactgaactgtttcccagaatggttgttttacatttccactagcaatatgtggaattccagttgctctacatactcatcagcacttggttttgtcaatatagttattttaatcatcctaataagtatgtagtgatatctcatttagtgattcatctaatggctaatgataataaacaactttctgtgtgtttgccattcatatatcctcttttttgaagtgtcattaaacagacattttgaatgcattgttaagatttcttgttaaggatttaactatgaatttttctttttgttttcttttctttgtttttttgagccagtcttgctctgtcacccaggctggagtgcagtggcacgatctcggctcactgcaacctctgcctcctgggttcaagtgattctcatgcctcagcctcctgagtagctgagactataggtgcgtgccaccattccccagctaattttttttttctagtagagatgaggtttcaccatgttggccaggctggtcttgaactcctgaccttaagtaatccacccaccttggcctcccaaagtgctgggattattggcatgagccaccacacccagcctggatttattttctttagtagatatagaattttcaggttatctgtttgattttaggtgagttatttatttattttttatttatttattttttaagactagccaagggcagtagtgaaaagaggggaaagagtttgggtgagtttttatagtttgtatctttcaaggaattggtccatttcatataacttacagaatttatgggcatagagttgtttgtagaattcccctattattctttaaatgtctatggggtctttagtgatatcccccttttcccttctcattcttgatattggtaaattgtttcttctcttttttttttcctttgccattcttgctggcactttgtcttttttttttttttaacttaaaaagtgtttttagggctacaggtgcatgccactggctgtttttttatttttatggagatgggggtctcactgtgttgcatagccttgtgtcaaactcctgacctcaagtgatcatctcttctggacctcccaaagtgctgagattacaagtgtgagccaggccttattgtgtcaatttaatggatcttttcaatatttttggtttcattttctatgttttgtcagttacattccactcttaatgtagttaagattgctgtagttttattttattctttttctaatttcagagatgatcgtttagattatttatttgagacctttttcgtttctttttttgctatttttattctattttattttattttatttttttgagacagagtcttggtctgtcacccaggctggagtgctgtggcgcagtctccgctcgctccaacctccacctcccaggttcaagtggttctcctgcctcagcctcccgagtagctgggattacagtcaggcgccaccatgtccagctaatttttgcatttttaatagaggtgggatttcaccaggctggtctcgagctcctgacctcaagtgatcgccctccttggcctcccgaagtactgggactaaaggtgtgagccaccatgcccagccttttttttttattttggtattttataaagttgatatattaacagcatattgtgtatattttggggttacatgtgatattttgatacatatatgcaatgtgtaatgatgaagttaggcttagtgatatatctatcatcaaacctttatttttgtgtcagaaacattataattctcttctagctgttttgaaatatgcagtaaattattaactgtaatttcttgactgtactattgaatgctagaatttattccttctatctaactgtatttttgtacccattaaccaactatttttcatcccccgcttcctttcccagcctctggtaaccaccattctactctccacctctgtgagatccacttttttagctctcacatatgagtgagaacatgcgatatttgtctgcgtattcctggcttatttcacttaatataatgacctccattttccttcattttactgcaagtgacaggatttcatttgttttaatggctaaataatattccattgtttatatataccacatttcttaattttactcatttgtccattgatggacacttaggttgattccatatcttggctattgtgaatagtattgcagtgaacatgggaatgcagatatctctttgatatactgatgtctttccttttggatatgcccagcagtcaaattgctggatcatatggtagttctatttttactttttcgagacacctccatactgttttctatgatagttgtactaccttatattcccaccaacagtagtatgaatgttcctctttctccaaatgctgaagagtaacaaatcctctccagcttttgttactttttgtcttttggataatagccattctaacttgaggtgagatgatttctcattgcagttttgatttctatttccctgatgatgagtgatattggacattttccccatatacctgttggacattttttttccaacttttaagttctggggtacatgtgcaggatgtgcaggtttgttacataggtaaacgtgtgccatggtggtttactgcacagaccaacctatcacctaggtattaagcccagcatccattagctgttcttccttgtactctccttccccaccactgacaggccctagtatatgttgttccccgcctcccatgtgtccatgtgttctcgtcattcagctcccacttacaagtgagaacatggggtatttagttttctgttcttgtgttagtttgctgagaataacagcttccagctccatccatgtccctgcagtggacgtgatgtcgttcctttttatgactgcatagtattccatgctgtatatgtaccagcttttctttatccagtctatcattgatgggcattttggttgattccatgtccttgctattgggaatactgctgcagtgaacatacgtgtgcacgtatctttataatagaattatttatattcctttgggtatatatccagtaataggattactgggtcaaatggtagttctgcctctagatctttgaggaatcaccatgctgtcttccacaatgcttgaactaatttacactctcaccaacagtgtaaaagcgttcctttttctctgcaacctcaccagcatctgttgttttttgagtttttaattgccatcctgctggtgtgagatagtgtctcattgtggttttgatttgcatttctctaatgaacagtgatgttgagctttttttcatatgatggccgcatgaatgtcttcttctttttttttttgagacggagtctcgctctgtcgcccaggctggagtgcagtggcacaatctcgactcactgcaagctccgcctcccgggttcatgccattcttctgcctcagcctcccgagtagctgggactgggactacaggcgcctgccaccacgcccagctaatttttttgtatttttagtagagactgggtttcaccatgttagccaggatggtctccatctcctgacctcgtgatccgcccgcctcagccccccaaagtgctgagattacaggtgtgagccaccgcgcccggctgaatgtcttctttttagtggggttgttttcttataaatttgtttaagttcctcttagactctggatattatacctttgccagatggatatattgcaaaaattttctcccattctgtaggttgtctgttcactctgattatagtttcttttgatgtgcagaagctctttaatttaattagatcccatttgtcaatttttacttttgttgcaattgcttttggcatttttgtcataaaatctttgcctgtgcctatgtcctgaatggtattgcctagattttcttctagggtttttatagtttggggttttacatttaggtccttcattcatcttgcgttaattcttgtatatggtataaggaagggatccagttttaattttctgcatatggctacctggttctccccagcaccacttattaaatagagaatcctttctctattgcttgtttttgtcaggtttgtcgaagattagatgtgtgtaggtgtgtggtctaacttctgggttctctattctgttcattggtctatgtgtctgtctttgtaccagttgcatgctgttttggttactgtagccttgtggtatgaagtcgggtagcgtgatgcctccagctttaattctttttgcttcggattgtcctggctatttgggctcttttttcattcaatgtgaattttcaagtagtttcttctaattctgtgaagaatgtcaatagtggtttaatgggaatagcattgaatctgtaaattactttgggcagcatggccattttcacgatattgattctttctgtccaggagcatggaatatttttccacttgttggtgtcctctctcatttccttgagcagtggtttgtagttctcctcgaagaggtccttcgtttcccttgttatgtgtattcataggtattacattctttctgtagcaattgtgaatgggagttcattcatgatatggctctctgcttgtctgttgttggtgtaaagaaatgcttgtgatttttgcacattgattttgtatcctgagactttgctgaagttgcttatcagctgaagaagcttttgggctgaggtgatggggttttctatatataggatcatgtcatctgaaaacaaagataatgttacttcctctctccctgtttgaataccctttatttctttctcttgcctggttgccatggccagaacttccaatgctatgttgaataggagtggcgagagagggcattcttgtcttgtgccagttttcaaggggaatgcttccatcttttgcccatttagtatgatactggctgtgggtttttcatatatggctcttattattttgaggtatgttccttcagtacctagataattgagagtttttaacatgaagggatgttgaattttatcaaaggtattttctgcatctattgagataatcatgtttttgactttagttctgtttatgtgatgaattacgtttattgatttgcatatgttgaaccaactttgcatcccagggatgaagccaacctgatggtggcggataagcttttagatgtgctgctggattcagtttgctcatattttattgaggatttttgcatcagtgttcatcagggatgttggcttgaagttttctttttctttttttttttttttttttttttgagacagcgtcttgccctgtcaccaggctgaagtgcagtgacgtgatctctgctcactgcaacctctgcctcctgggttcaagtgattctcctgcctcagcctctcgagtagctggaactacagatgcgtaccactatgcccagctaatttttctatttttagtagagacggggtttcaccatgttggccaggatggtcttgatctcttgacctcgtggtctgcctgcctcggcctcccaaagtgctgggattacaggcgtgagccaccgcagccggccgaagttttctttttttgttgtatctctgccaggttttggtatcaggatgatgctggcctcataaaatgagttagggaggagtcccttcttttcaattttttggaatagtttcagtagaaatggtaccagctcttctttgtacctgtagtggaattcagctataaatctctctggtcctgggctttttttggttggtaggctatttattactgcctcaatttctgaactcattattggtctattcagggattcagttccttcctagttcattcttcggagggtgtatgtgtccaagaattcatccatttcttccagattttctagtttatgtgcatagaggtatttatagtattctctgatggttgtttgtatttctgtggagtcagtggtgatatctcccttatcatttctggttgtgtctgtttgattttctctcttttgttcttcattagtctagctaatggtctatctattttattaattttttcaaaaaagaagctcctgaatttgttgattttttgtttttttgaagggtttttcgtgtctctgtctccttccgttcagctctgatcttggttatttcttgtcttctgctagctttgggatttgtttgctcttggttctctagttcttttagttgtgaattttgagatctttctagcttcttgatgtgggcatttagtgctataaatttccttcttaacactggtttagctgcatcccagagattctcatacattgtctctttgttctcattagtttcaaagaacttcttgatttctgccttaatttcattatttacccaggagtcattcaggagcaggttgttcagtttccatgtagttgtgtggttttgagtgaatttcttagttttgagttctaattttattgtgctgtggtctgagagactgttatgatttcagttcttttgcatttgctgaggagtgttttacctccgattatgtgatcaattttaaagtgccatgtggtgatgagaagaatgtatattttgttttttgggtggagggttctgtagatatctatcaggtccacttgatccagagctgagttcaggttctgaatatctttgttaattttctgtctagatggtctgtctaatatcgtcagtggggtattaaagtctcccactatttttgtgtgggagtctacgtttctttgtaggtctctacgaacttgctttacgaatctgggtgctcctatattgggtacatatatatttaggatagttaggtcttcttgtggaattgaaccctttatcattatgtaatgcccttctttgtcatttttgatctttgttgatttaaagtctgttttgtcagaaactaggattgtgacccctgctgttttctgtttttcatttgcttggtaaatttccctccatcccttcgttttgagcttatgtgtgtctgcacttaagatgggtctcctgaagacagcatactgatgggtcttgactctatccagcttgccattctatgtcttttaattggggcatatttagcccatttacatttaaggttaatattgttacgtgtgaatttaatcctgtcatcatgatggtagctggttattttgtagacttgtttatatggttgcttcatagtgtcactggtctgtatacttcagtgtgtttttactaaagtacttcctttaggagctcctgttggccatttctatgtctttttttgagaaatgtctgttctggtattttgcccatttttaaattggattatttgttttttgctattgagttccttatatattttagttattaatcctaatcccttgtcagatggatagtttgcagatattttctcccattctgtgggttgtctctgcactttgttgattgtttcctttgctgtacagaagctttttggcttaatgtaattatatttgtgtattcttgcatttgttgcctgtgcttttgagttcttactccaaaacaatctttgcccagaccaatgtcctatagcatttccccagtattttcttgtagtagtttcatagtttcaggtcttacatttaagtcttttaatccattttcaattgatttttttgtatatggcaagagataaaggtctagtttcattcttttgcatatgggtattcggttttcctgacaccatttattaaagagactgttctttccccagtgaatgttcttggtgccttcgtggaaagtgagtgggctataagtgggtggatttatttctggattctctatgctgttctgttggcccatgtatctgttttaatgccagtaccatgctgttttggttactgtagctttgtaatataatttgaaatcaggtagtatgaggcttccagctttgttcttactgctcagtattgctttagttatttggcatcttttgcagttttatgtgaattttaggattgctttttctatttctgtgaagaatgtcattggtattttgttagggattgcatggaatctatagatcgtttttgggtagtatagacattttagcaatattagttcttccaatacatgtgcatatgctatctttccattttttgtgtgtccccttcaatttttttcatcagtgttttgtagttttccttgtagagatcttgcaattatttggttaaatttattcccaggtattttaagttttttgtagctattgtaaaggggattgctttttttagttttttttttagatcattcactgttagcacatgtaaatgctactgatttttgtatgttgattttgtatcctgcaactttactgaggtgttttttttgttgttgttgtttttgagacagagtctcgttctgtcacccaggctggagttcagtggcatgatctcagctcactgcaacctttgtcccccggattcaagtggtcctttcacctcagccacccaagtagctgggactacaggtgcccaccaccacacccagctaatttttgcatttttagtagagatgagggtttaccatgttgcccaggttggtctcaaactcctgagctcaagctatctgcccgtctcagcctcccaaagtgctgggattacaggcatgagccactgcacccagccatctttactaaatttgtttatcagttcttttatttttattttttgagatggagtcttgctctgtcacctaggctggagtgcagtggcgcaatcttggctcactgcaacctccgcctcctgggttcaagcgattctcctgcctcagcctccaagtaaccgggattacagatgcccgccatcacgcccagctaattttttgtatttttagtagagatggggtttcaccatattggccagactgatctcgaactcctgacctcaggtgatctgcccaccttggccttccaaagtgctgggattacaggcgtgagccaccgtgcccggcgaggcctgtagttttaattgttgtatttttttctggttttggtatcaggataatgctggcctcatagaatgagttttgtggaagtattccctcctcttcagttttttgagttaaggtagaattgttgttttaatgtttggtagaattcagcagtgaatccatcaggttctgggcatttatttgatgggagacttcttattactgcttcagtctcattacttcttgtctgttcaggttttctgtttcttcatggttcaagcatggtaggttatatgtgtccaagaatttatccatttcttcccagtttccaatttgttggtgtatagttgttcatagtagtctctacctttgtatttctgtgatatcagttgtaatgattcctttctcatgagatatttttaatttctaatgtaaacatttagtactttaaattttcctctaagcagagctttctttgcgtcccccaagttttatgttgcaatttcactttttttttttttttaatttttatttttattgatcattcttgggtgtttctcacagagagggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacatggcaaccatccgatttctcaatcttttccccacctttccccgctttctattccacaaaaccaccattgtcatcatggcccgttctcaatgagctgttgggcacacctcccagatggggtggtggccgggcagaggggctcctcacttcccagtaggggcggccgggcagaggcgcccctcacctcccggacggggcggctggctgggcggagggctgacccccccacctccctcccggatgaggtggctggccgggcagaggggctcctcacttcccagtaggggcagccgggcagaggcgcccctcacctcccggacggggcggctggccgggcggggggctgaccccccacctccctcccggacggggcggctggccgggcggggggctgacccccccacctccctcccggacggggcggctggccgggcagggggctgacccccccacctccctcccggacggggcggctggccgggcagaggggctcctcacttcccagtaggggcggccgggcagaggcgcccctcacctcccggacggggcggctggccgggcggggggctgaccccccacctccctcccggatggggcagctgccaggcagagacgctcctcacttcccagacggggtggctgccgggcggaggggctcctcacttctcagacggggcagctgccgggcggagggtctcctcacttctcagatggggcggttgccaggcggagggtctcctcccttcccagatggggcggctgggcagagacgctcctcacctcccagacggggtcgcgaccgggcagaggcgctcctcacatcccagacggggcggcggggcaaaggcactccccacatctcagacgatgggcggccgggcagagacgctcctcacttcctagatgggatggcggccgggaagaggcgctcctcacttcctagatgggatggcagccgggcagagacgctcctcactttccagactgggcagccaggcagaggggctcctcacatcccagacgatgggtggccaggcagagacgctcctcacttcctagacggagtggcggccgggcagtggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggccgaggctggcggatcactcgcggttaggagctggaggccagcccggccaacacagcgaaacccagtctccaccaaaaaaatacgaaaaccagtcaggcgtggcggcacgcgcctgcagtcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagaggagggagagggagagggagagggacaatttcacttttattaatggaaatattttctgttttcctgtgggatctcctctttgacccatgtttatttaaaagtatgtttaatttttatgtgttagaggtattccagttatctttctattgctgctttttgttctttttgttaagacatcattcttctggtttccttttgttctttgtcagtggtttccttttgctctttcagcctagttgatttagtctttgtatggtaaatacaatgtcagagcttccttagggacagtttttgtcagtttctctttttttttcccccgtaaatgggccatacttcccttttcgttgcatgcctcatggttttttttgttggaaactggaaattttgaatattataatgtggtttactctggaagtcaaattttccttcctcagtttgcttttgttgcttgttatgaactgcagtcatctattatttagtgacttttcccaactactttttacaaagattgtattccttattgtgcagttactgagtctccattccttagcctcattagtaagctgagactttctgatagagatttcctgacaactttgtttgtttggaaggcaggagtacagtggcacaatcttggctcactgcagcctccacctcccgggttcaagcaagtctcgtgcctcagcctcccgagtagctaggattacaggcatgtgctaccacgcgtggctaatttttgtatttttagtagagacagggttttgccatgttggcgaggctggtcttgaactcctgacctcaagtgatccgcctgcatctggagtttcttaaagacatgatttagcagcctttttctttgttaatcaccccttgttgttgtgagatttttattggactccagagttccataaaagttgttctgacagtttttgccaggttgatggttgtttcagtggagggacagatcattttagctccctattactccattatcagtggtgtcactcctccttccctgcaccctcttcgtgtgtgtgtgcgtgcgtgtgtgtgtgtgcacacgtgcacgtgcatgttctttttttttggtaaaaaacacataccattaaatttatcatcttttttccattatttacctttaagctccgttagacttgacaaatttaccatcttaatcattttaaagtgtatagttcagtactattaagtatattcacattgttgtgcaacagatctctataactttttcatcttgcaacacttaaactgtatacccctaaacactaattcctccctctagccattggtcatcaccttctactttctttcttttcttttttttttttttttttttgaggcagagtttttgctcttgttgcccaggctggagtgcagtggcacgatcttggctcactgcaacctccgcctccaaggttcaagtgattctcctgcgtcagcctcctgagtagctgggattacaggtgcgcgccaccacgcccagctacttttttgtatttttaatagagacagagtttcgttatgttggccaggctggtctcgaactcatgacctcaggtgatccacctgcctcagcctcccagagtgcagggattacaggcatgagccactgcgcccgacctctactttctatttctatgattttgacacctttaggtactttgtaagagtggaattgtatagcatttgttctggcctttttttcttagcataatatcttccatgttcatccatgttgtagtatgtgatagctttcctttttttaaggctgcataataactgctgtgtgtacctaccatactttcttttatttttcctttttttaaattatacgtttctgggatacatgtgcagaacgtgcaggtttgttacataggtatacatgtgccatagtggtttgctgcacccatcaacccgtcatctacattaggtatttctcctaaagctatccctcccctagcccccttccccctcacaggccccagtgtgtgatgtttccctccctgttttcatgtgttctcattgttcaactctcacttatgaatgagaatatgcggtgtttggttttctgtcctgtgttagtttgctgagaatgatggtttccaacttcatccatgtccctgcaaaggacacgaactcatcctttttatggctgcaaagtattccatggtatatgtgtgccacattttctctatccagtctatcagtgatgggcatttgggttggttccaagtctttgctattgtgtacagtgctgcaataaacatacgtgtgcatgtgtctttctagtagaatgatttataatcctctgggtatatacccagtaatgggattgctgggtcaaatggtatttctcgttctagatccctgaggaatcgccacactgtcttccacagtggttgaactaatttacactcccaccaacagtgtaaaagcattcctatttctccacatcctctccagcatctgttgtttcctgactttttaatgatcaccattctaactggcttgagatggtatctcattgtggtttcgatttgcatttctctaatgaccagtgatgatgagtattttttcatatgtttgttggctggataaatgtcttcttttgagaagtgtctgttcatatccttcacccactttttgatgggattgtttgtttttttcagcccaggtgatctttttgttccctttgtgtgcattaagtatgtactgtttatttcttcattcacttagtaaacagttactgagaacttgtgcttcagtgtgctagtaggctcccttaatttgaaataaataatacatattcctgcccttatggtaaattggaggcaacagatttgctaatcagctcttaaataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggctggatagtattcacactgaggatgcatccttcagttagtttttgctgcttaacagtctgcccaaaacttagtggcttaaaataacagttaataatttttcataattctgtaggttggctgagctgttcttctagtctaggccagattccctggggctgaatggtctcaaaagttctccttcaggtgtctcagacctactatctaagtcctactaagacctactatctaagatggccaaggcttctctctacatggtctttagtctaccaagcttttccacaaggtggcagaaaggtttctagcagcaagagaggacaagccccaatgtgcaagcacttttcaagcctttgcttaagtcatatttactgttgtcccattgactaaaacaagttacgtggccaagccttgatcccatggttgggaaatagattgcaccttttgagaggagaactgcaaagtcacatcgcaaagtatcatgcatacgaggatacatgagcacactgaaggccattactgcaacagtctgccatagaggtcattgggatttcagtacctgtggttccccagcagataaagggcttgctcttctcaccctgccttatttagactttttggtgtttgcttgaggtcgagggggtgacataggggtagcagggcattcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggaaaaaaaaaaaaatttggctaggtgcagtgtggctcatgcctttaatcccaacattttgggaggctgaggcgggtggatcacttgaggtcaggagtttgagaccagcctggccaacatggtaaaaccccatctctactaaaaatacaaaaatcagctgcatgtggtggcatgtgcgtttagtcccagctactcgagaggctgaggcacgagaattgcttgaacctcggaaagcggaggttgcactgagccgagaccatgccactgcactccagcctgggcaacagagcgagactccatctcaaaaaaaaaaagaaaacttaggcctatttttaaattttattttcttctatcatttccaggtttatttttcctgtcaaagtaaatttttctggttagcacagtagaaaatttagaaaatattgaaaataaagggaattatgaagaaggaaccacccacgagtccgccacccagaagcaaccaatgttaacattttgacatgtttctttatagtcttttccctatacattttttaatttttattgtttaaatcacatgtgtgtacaattttttaaatttttttttaaattttttttaaatggagtctagctctgtcccaggctagagtgcagtggcgggatcttggctcactgcaatctccgcctcccgggttcaagctattctcttgcctcagcctcccaagtagctgggattacaggcaggtgccaccatgcctgactaattttttgtatttttagtagagatggggtttcaccatgttggccaggctggtcttgaactcctgacctcatgatctgcccgcttcagcctcccaaagtgctggaattacaggtatgagccaccacgcctggccacatgtatacaattatgcactgtactttaaaattttgtttgagcttttgatcaaagtagtgggtgtagcatatcaaaaagtatagagaaattaggccaggtgcggtggctcacgcctgtaatcccagcactttgggaggccgaggcgggtggatcacaaggtcaggagatcgagaccatcctggctaacacggtgaaaccccgtctctactaaagatacaaaaacttagccgggcgtggtggcaggcgcctgtagtcccagctactcgggaggctgaggcaggagaatggcatgaacctgagaggtggagcttgcagtgagccgagatcgcgccactacactccagcctgggtgacagagcgagactctgtctctcacacacacacaaaaaagtatagaaaaatttaggaggaaaagcaatgttcttctgcccctactttccccacctgcaatcccgttcccaagagacaacctcatagttttcgtttcctggtagatgcctccaaaactcaagagaagtatgccaccctttcttggtttatgaagtctatttctcctttaatcaacttacatcattcccttttttttttttttttttttttttgaggcagaaactcgctctgtggcccaggctggagtgcagtggtgcaatcttggctcactgcaacctccgcctcctggattcaaacgattctcatacctcagcctccaaagtagctgggactataggcgcgcatcactgcacccagctaatttttttgtatttttagtagagatggggttttgccatgttagctaggctggtctcgaactcctgacctcaagtgatccatctgcctcggcctcccagagtgctgtgattacaggccgtcaatctctcttgattacctactttgtaagatacagttgttggtgaccctacatccatagggtccttttgtaaccttctgtgaaccattttttcccttgtgggaagtaaatctaaagctgaattttgaagggtgagttagtaaagtaactcatgaagttattcaccacactaaatggatgttgtgtgaatgaatcagaattaggtgaatctagaaggacatttgccgcaaggatgcaaagtagaagggcatgaaattgtatgtggtacattcagagactcttggagttgagtatggattaagtaaaaggtacatttataggggaggggtacattcccttttgtaaccttctgtgaaccataattttttgtttatgctgtcaagtttattaacatatacattgttgttactactctacattgactagaaattaactgtaaatatcgaaaaccaatagagacatctggtcttttaagttaatattatatcataagcatgttcctatgccattgtttataaataatatttttaatggctacaagatatcagttccatggatatacctaatatatatgtaatttctaacatataggctattttcaagtttttacaattagtacatttggagtcaatatctttatatgtaaatgtttatatctctgattatttactcaggatggatcaccatgaaaccttagaggggccaaagtatgtgaggttatacaatgaaaagtttccttcccagccctgttagtagccttctacttacccacctggagtcaactagtgttatcagcttttttttttttttttttttttttttgagagggagtcttgctctgtcgcccaggctggagtgcagtggcgcgatctctgctcactgcaagctccgcctcctgggttcacgccattctcctgcctcagcctcccgagtagctgggactacaggcacccgccaccatgctaattttttgtacttttagtagagatggggtttcaccgtgttagccaggatggtctcgatctcctgacctcgtgatccgcccgcctcggcctcccaaagtgctgggattacaggcatgagccactacgcccggccatcagttttttcatttatcttctcagagacagtttgcacatatacaagcaaatgcatgtatatgttttcctacctccccctccttttttttttaactcagttggaaacgtattttatacgctgttatgtgctttgcttttctctcttaagaatacatctgggccaggcacggtggctcacgcctgtaatcccaacactttgggaggccagggtgagcggatcacgaggtcaggagatccagaccatcctggccaacatgatgaaaccccgtctctactaaaaatacaaaaattagctgggcatggtggcgcacgcctgtagtcccatctactcaggaggctgaggcaggagaatcgcttgaacccgggaggtggcggttgcagtgagccgagattttgccactgcactccagcctgggcgacagagcaagacttcatctcaaaaaaaaaaaaaaaatagttcttgatacttattgcagaagtgttttccagaaaagttgtaccaatttacacttccatccgcagtgcttgtttatgaaatgtatgcaggcattgaacacaccagttaggagtagtatttgattatgagtaatgtctcaagcatccttagtgagtgcttgttctctcagagtcacaagatggctacttcacctccagcattggggtctgggctgcagtcaggaagaaggagaaaagcaaaaggaaaaagggacaggcatgctgagtgctgagcattccctctccccaaggagttttaagttccacgttttttacacatctatttggctgaaattgtgtcagatggccaagactatcagccagagatgctaggagatacagtttttatctaggcatattgctgtcccacaaaatcagtgtttttgttagtaagcaggaaagagaatgacatttggttgagaatgagtagtctctaccatgagggtttttttgtttgtttgtttgtttgttttttatttattttgaaacagtctcggtctgtcgcccaggctggagtgcaatggcatgatcttggctcactgcaacctctgcctcccgggttcaagcaattctcctgcctcagcctcccaagtagctgggattacaggcacctgccaccacactcagctaattttttttgttgtttgttttttgagacagagtcgttctgtcaccagactggagtgcagtggcgagatcccggcccactgcaacctccgcctcctgggttaaagcaattctgcttcagcctcctgagtagctgggactacaggcacgcaccaccgcacccagctaattttttttttttttttgtatttttagtagagacggcatttcaccatgttggccaagatggtctcgatcccttgtccttgtgatccgcccatgtcagcctcccaaagtgctgggattacaggcatgagccaccgcgcctggccagttttttgtatttttagtagagacagggtttcgccatgttggccaggttggtctcgaactcctgacctcaggtgatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatgtaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaaaaaaaaaaaaaaaaagaaaagaagagaccaaatcatgatgtgagccagtagggtgagaatcctgttcacttttggccatcattgtatctgtagcactttgcctagtgcctggcctgtaggagatgtttaacaaatatttgatgagtgaaagataagatataattgtataatcgatatagaaaacacaggtatggggctgagcatggtggttaatgcctgtaatcctagcactttggaaaggtaagatgggaggattgtttgagcctaggagttcaagaccagcctgggccacatagtaagaccctgtctctacaaaaaatagaaataaaaatagagatatgatataattatgtaatatcagaaaatgaaagagaatcaactaaaaactgctaatactgataagagaattcagtaaattgggtaaatcattggatatataccagctatccaaaaatcaagaagtactatattagtaataaccataatgtactgagaaaaagaaatgctattgacaatagcaacaaacatataaaatatgcaagaataattgtaagaagatagtgtggaaccgacatgaagaaatagagatttcccatatgcctggttataaagactgagtgttgtaaagagtcatttccttccaaattaatgtatacatttaacactagcctaaatcaaaatcctaatggaattttgtggggaattcattctaaaagtaatttaaaaagtaaacaggtataattagcttaaagaatattgggatagagaaagtaaatgaaatatactatagtgctacagtaatcataagcaccagaacagtcggtaaatacttttccttttaaaaaatttttgttatgaaagttttcaaacataagataaaattcaagaggttattaccatgaacacctatatatatatatatatatatatctgtcacccagatttaatgaacattttgctgtatttgctttattctttttttcaaggcattttaagcaaaatcttacgtgttacgacatctctagttttttgctgattttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcctagctaatttttatatttttagtagagttggggtttcaccgtgttggccaggctggtctcgaactcctgtcctcaggtgatccacccatcttggcctcccaaagtgctggaattacaggcatgagccaccgtgcccagccctaggatcccattttaattccttttttttttatctctctatatgtgaggggtttttttttgttgttgttttgtttttttttttttgagatggagtcttactctgttgcctaggctggagtgcagtggcacaatcgcgactcactgcaacctccacctcccgggttcaagcaatactcccgcctcagcctcctaagtagctgggaatacaggcacacaccaccaagcctgggtgatttttgtgtgtttagtggagacggggtttcaccatgttggccaaactggtctcaaactcctgacctcaggtgatcggccgcctcagcctcccaaagtgctgagattacaggcgcgagccaccgcacctggccaagttattttcttagtggttgtcctggggattaacaacttaatttataccattctaattcacattattatcacttaatttctttctttcttttttttttttttttgaggcagagtctcgctgtgtcgcccagattggagtgcagtggcaccatctcggctcggctcactgcaagctctgcctcccgggttcacgccattctcctgtctcagcctcccgagtagttgggactacaggcgcctgccaccacacccggctaattttctgtatttttagtagagacgaggtttcaccgtgttagccaggatggtgtccatctcctgacctcatgatccgcccgcctcagcctcccaaagtgctgggattacaggcgtgagccaccgcgcccagcctattatcacttaatttcagtactacacagaaactttgctgctatatagctccattacccttctcttttatgctattactgtcacaaattacatctttatacattgtgttcatgaacacagggttatagtaattgctttatgtaattgtctgttaatccagttagaaaaagttacaaaaatatgttgataatgtcttttaaatatacctatctagttacctttaccagtgctctttatttcttcatgtagactcaattgtctagtgtcctttcatttcagcctgaaggtttccctttaacatgccttttttttttttttgagacagagtctcgcactgtcgcctgggctggagtgcaatggcatgatttcagctcattataacctctgcctcccgggttcaagcaattctcctgcctcagcctaccaagtagctgggattacaggtgcctgccaccacgcctggctaattttttgtatttttagtagagacgggtttcactatgttggccaggctggtctcgaactcttgacctcgtaatctgcccgcttcggcctcccaaagtgctgggattacaggcatgagccaccacacctggccctttagcatttcttataggtaaggtctactagtgtcaaactatttgtttttatttatctaggaatatcttgatttcttcatttttgaaggatagttttgctggatctggaattcctgattgatagtttttcttttagcacttagaatatgtcttcgcactgtcttctaacctccatgggttctgatgataaagaaatcactttatgttgtgagtcacttctgccttgctgctttcaaaattctgttgtcgttggccgggcacagtggctcaagcctataatcccagcactttgggaggccgaggcgggcggatcacgaggtcaggagatcaagaccatcctggctaacacgatgaaaccctgtctctactaaaaatagaaaaaaaattagccgggcgtggtggcgggcacctgtagtcccagctactcaggaggctgaggcaggagaatggcgttaaccctggcggcagagcttgcaatgagccgagattgcaccactgcactccagcctgggtaatggagcaagactccgtctaaaaaaaaaaaaatttctgttgtctttggtttgagttatgatgtgtagccttttaaatttgttcagcttggagttcgttgagctcttgaatgtataaattgtttttcatcaaatttggaaagtttttagttgttatttcttcgaataggtgtccttcagatccctttggctctgttcacttttcttcattctctttttatgtgtgctcatcagactggataatctcaattgacttatcttcaaagtcagtaattcttccttctacctgctcaaatgtgctattgaaaccctctagggaagtttgcatttcagttaaagtttgcatttcagttattttacttttcaacttcaaaataactgtttggtttctttttataatttctgtctctattggtattctctgtttggtgagacatcatactcatactttcctgtagttccttagacatggtctcctttagcctttgaaagcatttaaaatagctgatttaaagtccttgtctagtaactccaactatgtctaggaagtcagggacagtttccactgattgattttttttcttgtgaatggctatactttatttctttgtatgtcttgtaattttttgttgaaaactgtacattttaaatgccgtggcaactctgaaaatcagattttctccactctgctcctcagagaacactctttgttgtagttgtgttttgtttagtggcttttctgaactaattctgtaaagtctgtaaacttttttgtgtgtgcacactgatgtctctactcatttagcttagtagatgtctcatgattggacacagatttcctgaaatgcctggaaccagtgagtgctcccagtgcttgctgaggggctctctatgtgcatgttggagcatgccttcactcagccaggcagtttacaactctgcggtagccttcacttctatttgtgtagcacctcaaagtcagacagaggtgcatgcttagggccttctcaagtcttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaatccattcaaggattacacaatgcatttggttattataagctcttagtcttgttcattatttaaaatttgttaatatgacaattttattttattttttgagacagagtctcactctgtcgcccaggctgaagtgcagtagcgcgatctcagctcactgcaatctctgccctcggggttcaagtgattctcctgcctaagcttcccaagtagctgggattacaggcacgtgccaccacacctggctaatttttttgtatttttagtagagacagggtttcaccatgttggccagcctggtctcaaactcctgacctcaggtgatccgctcacctcggcctcccaaagtgtattatgacaattttattttttattttattttattttatttttattttatttattttttgagacggagtttcgctcttgttgtccaggcgggagtgcaatggcacgatcttggctcaccacagcctctgcctcctgggttcaagcgattctcctccctcagcctcctgagtagctgggattacaggcatgcacctccatgcccggctaattttttgtaattttagtagagacagggtttctccatgttggtcagactggtctcgaactcctgacctcaggtgatccacccacctcggcctctcaaagtgctgagattacaggcgtgagccaccgtgcccggccgacaatttttaaacatatgtaaaagtagaagggatagcacctgaatacccatagtcttaatactcagattctatagttgtaacattttgctatagttgcttgattcctctatctgtatctatctggctatctatagtttttgctgagccacttcaaagtcatcataacatattttacccgatggttcacgcctgtaatcccagcactttgggacaccgaggcaggtggatcatttgaggtcaggagtttaagaccagcctggccaacatggtgaaaccccatctctactaaaaatacaaaaattagccgggcggggtggtgggtgcctgttatcccagctacttgggaggctgagaaagaagaatcacttgaacccaggaggtggaggttgcagtgagtagaggtcacgccactgcgtgactgtgagactccatctcaaaaaaattaaataaggacatccgccattccccggtgtaaccacactacttttttttatacttaccaaagttagtaataattccctaagatcttcagatacccagttcataaccaaatttccccaactgtttacacaaaatatcttttataggtttttttccctcccaaaacccaggtctaatcaaggagggttcttttttccccagcttaaaacaaccaccattttcttatgttcatgtattctgtgggtcaggaatttggaaatggcacaatggcgacaacttgtctctactgcatgaagtctggggtctcagctggaaaaactttgaaggctgggggtgacttgttggccaagagtttgagtcatctgaagtctttcacttacatgtttgatgcctggcctgggaggacacaaaagactgaaagtgccaacatgtggcctctccatgtgactagcttcctcactgctcagcagcctcaaggcaatcaaactttttacatggcggttcagattgctaaaagcatgagtgttccaacaagcagtgtggaaactgaaattgcctttactgaccttgcctcaaaagtcatatagtgtcatttataccatattctatagcttgcaaataagcctgcttagattcaagagtggggcacagatctcacctatcagtaggaaaggtgtgatgggatttggggtcatgttttaaaaccaccacacatacaaaactatagagaacaatataaaagagatccaagtatccatgactgaaaattatgcgtcaacttttggtaaatttgcttcagatcatgttttaaacaaatgttacctttaaagaaagaatttcagccttccgaattgcttgttctagaatctgcatactgcttatccagaaattctcctttataatagcaatagctaaccaaggagtttaaatctaggtcagcagtaccaccacatcttttttctgtgacattagtttttttctttaaaaatataataaggctgggcatggtggctcatgcctatggttttggaggccgaggtgggtggatcacttgaggttaggagttcaagaccatcctggccaacatggtgaaaccccgtctctactaaaaatacaaaaattagccgggcatggtgttgcatgcctgtgatcccagctactcaggaggctgaggcaggagaatagcttgaacccgggaggtggaggttgcagtgagccgagatgaccccactgcactctagccttgggcgacaaagcaagactccatctcaaaaaataaataaaaatagaatagttcattgagctcctatatatccaccagtgagaatgaacagttattaatatattgccgtattggcttcatttatcactatcttgttttttaaatttttttctttgcttgaaagcaaaccccagttattatgctgtttcccccaagtatttcagtatgtatttctaaaaagtggatattttctcaccaaaccttacaacctgttattatacataacaaaactaacaataatttgataattctttatataattccaagtccataatcaaatttcctaaattgtcaaaccatgaaaaggtgtttttatattagatttgtttaaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaatttcctattgcttctcatcaagaggcgtgtgaagttgtgttgtgctttctcactattagtgacagtaaagttcatacttaaagtggtaatctcttgatctcatcattataagttttttcttcttgaggtgaatgggtaatattttggtgctgtgtgaatatccaattccctagaatcaattgtttcattaggacttgccagcttgtggttttctaattctgtcattccttctacatttagtagctggctttcttctgtaaagaagagctgtctctcatcatttagggctgtttggttatcctgaaatacacttccttttgaaatggtgggatgagtatttttttatttcaggttggtaaggcattataaaagagtcatgcaagagggtggtcttcttcaggaactcatagcctggctggtagacagaataacacatcagcattagagaatgagacaaggtggtatgtgctatgtatcaagtaatttatacagatcataagttcaaaggaaaaagagatcagtggaaccaaagaggttttgtgtaggagattgatttcagcttaccttaaagaatgggtaggttttgaataggcagacaaaaaggaagatagtactctaggtggtgtggattttgaggatgaaagcatagggagagaggatgagctgtacacactctggagatgtaataaggaagccatccgtctggagaagctgagaatatggatgtggaaataaggttggagaggtaagtgggccagaagcagaatatgggacaaacttaaatgccagttcagggagattaactttttatttttattattattttattattattattattttttgagacagagtttcactgtgtcgccgaggctggtgtgcagtgatgcaatctctgctcactgcaacctctgcctcccaggttcaagcaattctcatgcctcagcctcctgagcagctgggactacaggcgtgcaccaccatggccggataattttttttttttttttgagatggagtcttgctgtgtcgcccaggctggagtgcaatggcgcaatctcagcttactgcaagctccgcctcccaggttcatgccattctcctgcctcagccttctgaatagctgggactacaggcacccgccaccatgcctggccaattttttgtatttttaatagagacggggtttcaccatgttagccaggatggtcttgatctcctgacctcgtgatccacccgcctcggcctcccaaagtgctgggattacaggtgtgagccaccgtgccggccaatttttattattattttattactattattattattattttttgagacagagtttcactgtgtcgctgaggctggagtgcagtgatgcaatctctgctcactgcaacctctgcctctcaggctcaagcaattctcatgcctcagcctcctgagcagctgggactgcaggcgtgcaccaccatgccgggataatttttgtatttttagtagagacgaagttttcgccatgttggcgaggctggtctcgaactcctggccacaagtgatccatctgcctcagcctcccaaagtgctggaattacaggtgtgagccactgcacctggcctggcttattgttctatttttagagacagggtctcactctgttgcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggagcctttggaggtgaattctctggttatcttgcaatcaatatcccgttagctcctaatcccatatcctatagcttagagcactgttaagcatctgctttgttagttgcttccatatataatgtgtaatgtaatctatctgcccaatagccctgttcaacaggtgatattttcatcattttataggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttcaagagtgggaatatatttaatttaacttggtatccccactatggtcagaaaatgtgtttagtcagtattggggtgggtgggtgagtgaatgaatgaatgaacgaaagaaagaaacagatctttctgtattggagatttcatgttggggaattagttaaaataagtaatgattataagaatggattctagagtcagcctgcttggatttaaattatgtaatagttctaccatttgggcaagttaatttctctttgcctcatttcctcatagacttcattttaggattaaatgaggtaatgtacgtacaagctcttttagaatggcagttgttatggagtaagtactataggcctgttagcttttttcatcattatcattatgggttggctaagtgtaaacagccagactgtggaagatcatgaatgtcaggccagggagtttgaacttgggcggggatctgctaacagctttttgagcaacgggattggcaaggtgaaagtggttctgtcataagatggtctagttgtctgtgggagtatctggataaattatatgtgaaagagattggcagcaaaggtagcaaaatttaggctagtgatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggtacaacggccatatggttgtagaaccgaaggatcttagagccacctgccctaaatcctaagtgctctagtagatgacaataccagggagggacactgaaggccaacctaaggtgcttggatttgatcttatgggccatggagagatgttgactgatttgaagtacagacaagatcaggttttagttttgaaagatccttctggtggccagaaggaggtagagggtgggctagagatgggaactctagggaggaggcacatatacaagttcaggcaggcaggaagagtacctggggctctgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagc

SEQ ID NO: 911 - DNA, 107233 bp, mus musculus
acctcgcgagtccagccctcataagatggcggtcgccttggttgtctgggtagcgccgccactctcaacatggtagctgtttatcccgtatttctcctcccctctccgcctcaacttcctcattgttttgaataaactttattgactactccgaattgcctaccaccgccactgggcttctcccagcgacttttcgggccgtgtgcctcggacgtggcggccggttcatctctttccccgttggtttgctcgcgagtatctcctgccggcccagcgacgacgccacttgcccgttcgccgggcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctgtaagttttgggggctgcgaggctattactgtcagttttaggatatactgtgaggtacctgaacatttggggagactagggagctctcatcagtttgagggggggctgcaaggaaacgctgccagtttccgagcgatgcaaaagaatccttgcttagtttcgggagtgtgaggaaattctagtcagtttgaggggttttgaatagatccttttgagtttcagggatgcagccagaaccctgtcatctttaaagtacagaacgagctggtcagtttagagatttatatttatttcagttttgggggtgatgagactcctgactggtcggggaaggaatgatattgagagtgatggaaaggattatttaaactctccgaacacgaccccagaactgtgatttgagttgggcgcctagtcttgtctgtcttgttcgtgaaggctttgagtaacctgaagagactttcagggatcccttatctctctctggttggccctatttcaggtggtgagaggagggtcttgtcttgagatacccccagcctcatttttgacgctgtggtttgcgtcataatagagggagccctgtgaaacaggggtcagctaggggagggttcagtgagagatgaaagaagcttcccgaaaaggcttcaggtattttcttgaaacccggaaagaagttatcactgacaacggggccgaagaaggtggggggtggggagtggagagtgtgggggcggtgggaagcctggaaggttgagctccgttctttacgtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcaggtaaggagggcaggccaggctacacagggtgcggtggccaggtgtgttcacttgctctctcttcctttctcagctctgtttttagattccggctcaggaccccctctcccagactcaggttctgccatctctccttgcagaacaggacctagctgacattagcctctggtttctccttttcctgtgttttcccctatgtatttcttctttgcacttttcttttgagtgtttttttagatttataagacccccccccccttttctttcctgttacaaagaatcatttttatattcttctctattttattttttattttgttttatttttttcgagacggagtttcgctcgttgcccaggctggagtgcaatggcgcgatctcggctcacagcaacctctgcctcccaggttcaagcgattttcctgccccagcctccaagtagctgagattacaggcatgcaccaccacacccagctgattttgtatttttagtagagacggtgtttttccatgttgatcaggctggtctggaactcccgacctctggagatctgcctgcctcggcctcccaaagtgctgggattacaggcgtgagccaccgtgcccggtcatcatttttatagtctgacaattatgttctgcctcacacactggcttttgggaaaacagtgttgcttatttgaggtagttgagtccataaacagggatttaagttgtggctttgtacttagtttcagagtgaccatgcacaagttgctttgcttttctgagcctcattgtcttcagctataaaatgttatcaaatacatcctttctgactttgcaaagcagtttggatgtactccataaatggaggcagaaatggaagagtattttatttctacagcatttatctgcagcaccatccaactaaattgaattaagcagaatagatgctgggtaaaacaggagtaaaaccactgatgaatttccttcagttaaccgtgtgtgcacataagcacctgtcacccagaattccggagaggttagtgtgtacgataaaactaatatttcattaatgggatttaaatctcagctatggaaagacaaccttgagggggctttgtacactggagcacaacaaaacagtgtatggcaccctcctcctgttgcttgttagattctagaattttcagttgtctggtctcctccagaggggctatttctttttctttttttcttttttcttttttttttttttttatttgagacaaggtctcactcttgtcacccaggctggagtgcaatggcatgatctcagctcactgcaacctctgcctcccgggttcaagcgattctcgtgcctcagcctcccgagtagctgggattacaggtgcacgccaccacgcccggcaaatttttttgtacttttttgatagagatggagtttcaccatgttggccaggctggtctcaaactcctgacctcaagcgatccgcccgcctcagcctcccacagtgctaggattacaggcatgagccactatgcccagcaagctatttctgtttatcacactcaagaccaaactataggtgctggtgctgctaaaatcctgccctcagcagggactgcccccttgccccgtatccaaattcatgtttaactgatctctattgaatatttattgtgtgcccggcacagagttctgttttactgcctcatgttatttaagaggggacaaccctagagggtgggaccttttcctttgccctgaaaataagtggggattaagatgtctttcaggattcctggtgtctttgctagtgctgatcaagtcactcctcagcttaacattcttctttcagtggttcgtctctgggataaaattcagtatcctttatatgacagacaagaccttttgtgatctacttgtttattctcatttcctgccactcctcctctcttgttctttatgtcctagcaagactgaactacctatagttctgggaaaattttatactcctttatgcctttttgtctttgtacgtgcaaactcccactaatgccctctcccctttgcaactcacagactgtaaaaggtgtaaaagtccttcttcctcttggttcccattgcactttgtgtgcgtctttattaaaaagtaattatttaatcatatcatagttataaatatatctgtgtcattcgttagccagagcttcctgagggcagagatgtcttcttttcatttttggtatccccagaacctagttcagtgctaaacatgtaatagatgctgagtacatttttgaatgagttaatgagtcttcatgaaaaaaagctgttgcctggggcccttactttggattgtatgggaaatgtgtaggttcagacctgtaaaatgggctcctgctaactcctcactctggaaacagggaacaggaatgaatgcttcctgactgcttatgtctgccggaccccatgacagggacttgggacaaattatttagtctatatgcaagcctgaaagttggatatttctcttttaaataatgttcttaattttttcttgctcttatagtgagacctgcttgttgtagaaaacacagaaaaagaataaagaaggaaatataactcacctaagtctactactgtctggcacaatccactgttaaatttgttgttgcattaactcccatcttttgacttagaatataaacatatttttacaagatgggattgcgttataaataccattttacaacctattttttatttctagttaatgttacaatgtaattgccagttcattaaatattcagctaaacttgatttctgatatcccacaatatatatgtgtcaccggttaatttggtaatttcctttatggttggacattgtacttttttgaacattatttgtacttttttatattataaataatgtgaggaaactttgggcgttctggaaaggttttgcatcttgatatgagtgctgattaaaacaaaaacattatggaaagcatctttgcctagtagatacttgacatttatttataaggagcaccattgaggccttaaagaattctaaacttacaaatacagaaatgggcttatgggccaggcccctctttaatcacatttctgtggtgagttgtgtgtttctgtgtacactctaacacaagttaactgccttaatttttttccatgaaatacaccaaattttaaaaatctcttttgcttctctctatgggcccccactgaacaaggaagctagctgagaatcaggtccttgggggtggctgctcttgcttactcagtgcattgctcacagaaacacaccaggcttatagtgcgccatttaagtttgtacttcagcacaattggaaattactacatactgtggactttttatggttgcttgcaagagttaagccaacaaattttaaatccacagatacctagaggtgatagaaatctgttcatatctctagtgacttcttttttttttttttttttttgagacagagtctcactctgttgcccaagctgcagtgcagtggcacgatcttggttcactgcaacctctgcctcctgggttcaagtgattctcctgcctcagccttctgagtagttgggattacaggtgcgcgccaccacacccggctcatttttgtattttagtagagacagggtttcactatgttggtcaggctggtctcgaactgctgacctcgtgatccacccaccttgacctcccaaagtgctggtattacaggtgtgagccaccatgcccggcctctagtgacttttgtaggatagatttcttgaagtccagctagggattatggaatataatgccaagttactttttggaaaggttataacaagcgaggcaactattccattttgcagctgagaatctggaattcgtggaagttaagtgactttctgagtgtggatttgaactttgaattatttgattccagagcccaggttctcagaagtgcaaaaaacatggtattgcttcattcttcctgtaagaagctggattttgcaaaaacactttgatttgtacagcggtggttctcaaacttcagcatgtatcagactcacttggaagacctgatgaaacacaagttagggatgccctagctacagtatttctgattcagtaggtaagaagggcccacccttgagaaccactgatttagaacattatcctgtcttgattccttccccttctgcggagtgtgatagcttctgatactgagggatggatggactaacatatcattactgtacaccagtcattctctttttttggtacagaaaaattggaatgaacattctttttatattattcttttttaattcctaagtgagctaacacaggaggaacgaccttttttaaagtacagttcatcaactgggaatttgttcaaaatgcaatttcttgggctaggacttggactcagcagtctatattttaacaaacaagtgatcctgattcaccctaacatttgagaatcattgctgtacaatagtggagaaaactagttggcaagcatttattgatttctgggatttttagcacaaatttcactctacagttttcctgtttataaaagaaatattggttgatacatgcccaagggaataactttggtgtggatttttaactctagaggaaaggacactgatttcagatctgggttcaaattctgattctgttacatattagcaaataatttcttatctgtgaagccttagtttccctgagaggttgtgatgatttaaataaaatggttatagctatcgtttattgagcacaagctagtgttccactcactatgctaaccacttcgcctaattatctttatcttttgggggagttttaaaaattattccatttagtagttataggactattcaaattacctattttatgttggatgtgtactttccgagaattgacccatttcatctaagttgtcaaatttatgtttgtagaattgttcatagtatttctttattatccttttgatatcttcaggtgctgtagtgataattttgtttcattagtgatactaaaaatgtatcaggctgggcatgtgatgtcattcatgcctataatcccagcactttgggaggccaaggctggtggattgcttaagcccaagagttcaaaaccagcctgggcaacatggtaaaaccccgtctctacaagaaatacaaaaattagcagggtgggtggcacatgcttatagtcccagctgcccgggaggctgaggtgggaggattgcttgagcccaggaagttgaggcctcagtgaactgtgatcatgccactacactccagcctgggtgacagagcgagaccctgtctcaaaaaaaccgaaaacaaacaaacaaaaaaaatttgtcttcgtatttgtcagacttgctagaggtttgtcagttttatggatcttttcaaagaacaagctttttgtttcattgactttttctgttgtctttctgttttcaatttaatagatctctgcctttactatttttttcctcctttggtttattttgctctctatctagtttcttgaggtgggagattagattattgatttgagactttcttttctttttttttttttttttattttttctgaaacagcctgttgcccaggctggagtgcaatggcgcgatctcggctcgctgcaacctccacctcccgggttcaagtgattttcctgcctcagcctccctactagctgggattataggcgctcgccaccacgcccagctaattttttgtatttttaatagagatggggtttcaccatgttggccaggctagtctcgaactcctgacctcaggtgatccacccgcctcggcctcccaaagtgttgggattacaggcgtgacccacagcacccggcctttctttcttttctaatgtaagcctttagctgttaagtttcttctcagcaccaatagattttaatatgttacattttcccttttcatgtagttcaaggcattaaaaaaaaaaaaagtttttttttttttttttttttttttttttgagacagtgtctcagtctgttgcccaggcggtactgcagaggcaggatcatagctctcactgcagcctccagctcctgggctaaagtgatcctcctgctgcctcaaggcatttttaaattccccttgaaacttcctgtttgacccatgaagtatagaagtatgttgtttaattttgaagtttttgtagagtttcctgttatcgttctgttactgacttctagtttgatagtggtcagagaatatactttgtatgatttcaattcctttacatttattgagatttgttttatagcccagagtctatcttggtaaatgtttcatgatcactcgaaaagaatgtgtattctgccatttttgggtagagtgttctataaatgtcaattaactactgttggttaatggtgttgctgaattcttctaatccttgctgattttttcttttttcttttcttttttttttttttttttgagatggagtttcgctcttgttgcccaggctggagcgcgatttggctcaccgcaacctccggctcccaggttcaagcgattcttctgcctcagcctcctgaatagctgggactacaggcatgtgccaccacgcccagctaattttgtatttttagtagagacggggtttctccatgttcgtcaggctggtcttgaacttctgacttcaggtgatccgcctgcctcggcctcccaaagtgctgggattacaggtgtgagccactgcactcggcctactcattcattcattcatttatttttgagacagggtctctatgtcacctgggctggagtgcagtggtttgatcatggtttactgcagcctcaaattccagggcttaagcaatctcctcatgcttcagcctctacaatagctgaaactgcaagcatgtgccactgtgtgccctaatttttaaaattttttgtgtggggagggtgtgggtgtaggttggtggtacctccctttgttgcctgggatggtcttggacttctggcttcagatgatcctcccacctcagcctcccaaagtgctgggattacaggcatgaactactgctcttggcccgagttatctctgtattgcttttttcagtacttgctctaggtattacattatacatataacttaccataagcaactgctcttgacattttaccagtttgattgaagagtagaaactttacttttctttttcctttttttttttgagacagagtctcactctgtcacccaggctggagtgcaatgatgtggtctcggctcactgcaacctctgcctcctgggttcaagcgattctcccaccttagcctcccgagtagctgggactacaggtgtggtccaccatagccggctaatttttgtatttttagtagagacgagttttcactatgttgaccaggttggtctcgaactcctgacctcatgatctgcccgcctcagcctcccaaagtgctgggattacaagcgtgagccaccatgtccggttgaaactttacttttctttatatgccttaatgctcttttgtttataatctaattaatcgttttgttgttgttgagacagagtcttgctgtgttgcccaggctggagtgtagtggaacagtcacggctcacctgcagcctaaacctcctgggctcaagtgatcctcccacctcagccccccaccccccagtagctgggactacaggcatgcaccactatgcctggctgattttttttttttttttttttttttttgagacgaagtctcgctctgtcgcccaggctggagtgcagtggcgtgatctcggctcactgcaacctccgcccctccaggtttaaacaattctctgcctcagcctccagagtagctggaattacaggcgcccgccaccacgcccagctaattttttgtatttttagtagaaacggggtttcaccatcttggccaggctggtcttgaactcctgacctcaaatgatccacacgtctcggcctcccaaagtgctgggattacaggcatgagctactgtgcccagcctactcattcttttaggataagtgttggcaacagatacgtttagttttccttaatctgagaatatcttgatttcccttgaattcttaggggatcttttcacttcatatcgaactctgggtttctagttcttttatctcagcgcttgaaaactgttctgctacttccttttgccctccatggtttctgatgagagagcctctgtcattcaaattggtgttctccttgaggtaatgtgtcatttatctctcattgctttcaggatttttcctttgtcttttgcttttaggaatttgattaagccatgtcttagtgtggatttgttccggtttgtcttttgttgtagtcctgtaggttgctgaggctctgttcattttttttccaatctgttttctttctgttgttcagattggataatttctattgttctatcttcaacttactgattcttttctctgttttctccattctgctgttgaattttcatttaagttactaaagaattttcattgttactgtatttttcagttctaaaaattctgttagattcttttctatatcttctatttgtttgaagagattttctattttttgttgacactttctttttttttttatttgagacaagagtctagctctgtggcctagactggagtgcagtggtgcaatcttgggtcacttcaacctccacctcctgggttcaagtgattctcctgcctcagcctcccaagtagctgggattaaaggcacataccaccatgcctggctaatttttgctgacactttctatgtatttatttattttattatgatgatgatgatttttttctgagatggagtttcactctgttgcccaggctggagtgcaatggtgcgatctcggctcactgcaacctctgcctccctgggttcaagtgattctcctgcctcagcctcccgagtagctgggattacaggcacatgccaccacgcccagctatcttttgtatttttagtagaaatggggtttcaccgtgttggccaggctggtctcgaactcctgacctcgtgatctgcccacctcagcctcccaaagtgctgggattacaggcatgagccactgtgcccggcgacactttcaatttattcatttgtttcaggcatgttcttaattgctcattgaaacatttttatgatggcgcctttaaaattcttaaataattccaacatctgtgtcatctcagtcttaacatctgttgattttcttttcttattcgagttgtgattttccttgttcttggtatgacaaataattattttaattatattctggacatttggggcattatgtcacgagatcctggatcttatttaagacttctgtttttgcaggccttctcagacactgcgctccggtggcagaaagggggtaccacttcatgactgccaggtgggggtggaagtacaggttccccacttggtctttggtgctatccaccacctgctaggtgggtggatcctgctgtctctagtcggtctgctttcttcccttcacctttcagagttttatgtttgttttgtatatattgtccagggtttttagctgtacttggagggatagggaggagtgcatctacttcatattgttccagaaccagcagtgataggttaaataatgtgcccaaagctacacagacagctggaccacagatcaaacctgggtctcctctactttcactgtagaatacagtattatagacaatataagcactgtttaagttgttagaagttatggaagatagggaaaatcagatatgtgctatgtgccaggcattgttctggacaccggggtgggggaggggggatacggcagtgaacatgagacagtaaactaacagcttaatatatagtgtgtcaagtgataatacatggtctagagaaaagtaaagtagggtgagcaggagaaggagtaccaccccagggttgaagtagtggttactttatacaggatgattacagatgggttacctatgagcctgaaggaaagcgaggaagggaaccatgctggtaagtaggggaagagtgtttcaagtagaggacataaaggacccaagtggggagcagacctggcatgctaccagtccagtccaatgctattggaacagagtgagtgaggggagagtaatagaagctgaggttaagggtcaggggtgtgcagatcatatacagcagtgattttccaagtatggttcccagaccagcaggatcagcattatctaggaactgattaggccaattcttggatcccaccccagactgactgaatcagaaactctggagatggagccctagaatctgtggtttaacagcctttcagatgcacgctaaagtttaaaaaccatgggtatagggtgtaaggacttggtttttactctggatgggagccacagaagctttttgagcaagtgagagttgtgatctgatttaggttttggctcttgtgaggatagactaaaggtgaggagcaaggtagaagcagggagaatttcggggctactgtagatcattattccttaaagtgtggtccctggaccagcagcatcagcatcacctgagaggtcattagaaatgcacgtttataggcccaacccagtcctactgaatcaagatgtctggggatggggcctaggaatctgtattttaacaagcttaccaggtgtttctaatattccctaaaatctgagaaactttggtctagttaggcagtggtggcttaaagcagagtcagtgatgatgagaagtggttggattttgaatatatattgatacaggatttgttaatagattggattggggttgtggaagaaggaactcaagaatgactcaattttgaagaatttggtgtaaaggggactagagtaatggggcagagactgaggggatcacaaaagggttttttgtttgggttttttttttttttggagatagaacagtctgtctgtgtgcatgtcagtgcatatgaagttattccgttggtgcatccagaattcagtgaaacctgttatatgacaaactcataaaggagacacttcctaggtacgctggaacttgctgtgtcctttgcattcctttaagtcctgtgtgcctggagttggaggggtggggcggtgggaatggtggatgcttcagcttctggttttatagatggtgctctgtctggacctggatccttgggtaccctcagaaggcagaggttgaggagataagaagccagacaggatcttgagcaaaatcatcatctctcaggcatctccaagtctcagctcccactcagttccacatccctggaagagttgagtgtccattttggagtgctcataacacttgactgtattaatcaccccacattatatcctggttacatattgtagtgatatagtagagtcacaaagtcctgaatttgtatcctgctctgctacttagtagttttgtaattgccaacaatttacttaaccactcagacccagatttctcatctgttagattaggataatattaacgatgatgatgatgatagctaatacttaacatgtgccaggaactttaagtacttaactattttagctcatttaatcctcttaaccaccctgtgaagtgggtactattagtacttccatttcacagatgcagaaactgagatgcagaaaggtgaagtataaattgcttaagttcacatagctagtgagtggcagaggtgagattcaaacccaggcagtttggctcctaagcctgtactttaaacctctgcttctgtgtttaatgtctgtgaatgttgtacggaaggccctgatttgttgtggagattaaatgtgataatatgtgaagttcatagctcagtttttttctcagtgccttttatgctaacttcaaattcattcactcactatcctgttaccttgctttactgactttatagcacttacgaaactgttttgacactgcctctctgtctcccgctctaaaatgtccagtccatgagggcagtgtctgctcaatcaatatttgttgaatttatgcactcatttacttaacaaatactgcttaccgtgtgcttggctttgcagtataccatggggataactcatcttaatcacaagacctggtgctataataattatcctcttgactaaggaagctactcagagcaaatcagcatttaccacccttggtcccaggtggtaactatcgagacagtgcagccagaagcccgatttttcatttgtctgcctccctgatatgaggagttgtctagcacgttgatgtttgttgaataataagtaaggcaagactgagagatgggaaaggtgaggacttttggtaaataagatacactatctggcaaatgtagtggggacagacagcaggtaagtgagcaattccaaggcctcgtggtgaaggctgaaatagggatagtgttgtgggggtgccacagcagcagggaaaaggaagagcaggaatgttccaggtagaaggagatacctgtgatgaaacccagaggctagagctagacagagtatggcaccgagagtccgctggctttttagagcagagctggcttcatgggtgtgcaatcgttatagtcacatggtgccccatgcctgaggtttaatgttctgtggtggttgtcttgaaattcttaataattttgcctttgattttgtgattggtatgtgatggaacaatggagtgtgcgctggggatttaagagtcttggctcatatgtggttctacctcctgctgccattctacctccccgaacaggttcttggctagctgcctggggcactgggcccaggtgcaggtgtggacagagtcggttgggttcatgtaccctgtgtactaagtcaccgggcagggccccagggtacttgtgtgggcctgcactcgccccttgagttatccctatacccaagggagcgtgacagtaaatagcatattaaaactgcatggtaagttgagagagagaccatggaagaaaggaaaaagcttttctattttttgaacagggagctcccacttttcatttccattaggccccacagattgtaagtgggctatgcagtaggaatgtctcccccagcatacgctgtgtgtgaggggaaagacgtgagctcagccagagaggcaaggccttttgggccatggtaagtttatactttaccttaggaaaaatagggaccctgtgaggcattttaagcatgggttgataggatcaaatttgtgtttttaaatgatcactttggctgtagtgtggagggccgattgggtagggacagaataggggccaggagtccagttaggagggcaggacaataactgagttagagataatagtggcctgaactagcgcaggggcagtaaggatgacaaattaacacaattgatagctaataaagagagttgataggacatgctgataacttggataataacaacaaacatacacagcacttactatgggccagacactgttctaaacactttctatatatttagttcatttgcttttgataacaaccttgtgaagtaggtacagtttttatccccatcttacaatgaggaaactgaggcacagagaggttaagtaacttgtccaagatcccacagctagtaagtggcacagccaggatgcaaacccagagaatctggacctaaagtcagtgttcttaacttgatgctagaacgtctacttcagggtatagtggagggagagggctagaggtgaatcagtgatggctgccaggtttctggcttgaatgcctggtgaggttatggagccatttgcagaagtgggaaacctaagagaagggagcatgtttaggtgacagacagaaggagaaactgagtttggacatgttgaatttgaagtacgtaagtggctatccagtagaaatgtctcacccaggagacatttggagggaagggtctaatctggcttggagttatgagtgcatagagggcacatggagccctgggagtgagaacagtgaggaaaagtgaggagaaaagagtgcccaggtaagaggacctaagaaacttcaacatttaaggactgggcaggagaaaaagagttcatcgggaaaaaggaacagccaaagacatgattaaaatcacatcacatccctactcatagtggctgttactccccagttcttgtggctacccaggaaaagccagagtgctttacagtggcctacaacaccctactacatgagtctattgcctttctgacttattactgtcctcctacctctctactctagaacactctcctcctctctgctaccttcggagtctagggatgctcccaccacagggcttttgtacttgctgttcttattgggatgctcttccttcatagccacatgaggggcttgctcccttactccctttgggtctttattcaaaagccattttgtcagtctttccctgtcttccctatctaatatttcaccctcactaccattcttcctggcccccccattgtgtgtgtgtgtgtgtgtgtgtgtgtgtgtgtgtggtgtgtatagttatatattcacacatacatattcctctatatcccccttcctgtttttttttctacctaggtcttctcactatccagcatacaatgtgtttcaccaattgcattgatttatcttgtttcttgtctgcctccccactagaacatcagctctatgagggcagggatttttgtatgctttgttttttgtcttcgtctcaccagcacctagaccagagcctggcggatgctcattaaatgtcagctgaaggaatgggcaccagccagatgggacgttatagaagtcaaggatagagagcttgtcaggtggagagtgtacagggttggcagggcgaaaatggtgctaagaggttaagggagataaagcagagaagtacttattgcatatatcaacaaggaggtcaggaaaccagtgagatctattttaaagaaggtggggactaagatcagactagcaggagatgaatcacaaagtgcatatagcaaccctaaaaaagtatcgatttggctctgatagaacacctctggatactactaggcagctaagggtgggagggagactttttactgtatatacttctgtactctgagttttgcaccatgtacagctgttacttattcaaaagaggagtcattatcaagcttcgtaggtttatttacttcatttttaagctgcataggtttaaagaaagaatgtgtttggctgtgaaggggcggacagaagggagggaggatgggagggcgggtaggtcttggttttttaatttgtaaacatcaatagacttgtttaaatgctattgtgaagagaaagagagagattgaagatactgcagaaagaaggaataattgattgagaaggtaagaaaacatgtgacccaggtggaaaacttggctttagaaggaaggaaagatagtacttttgttgtgataggaaaaaaaggatgggtgtagaaggaggtagattggtgatgagaagttaaggtagttcacctctgattacttaattttctctaagaagtaggaagtgcatcgcttcttggtcttttggctaagatcaagtgtagaagtaggaagtggctggcatgatggctcacacctgtaatcccaacactttgggaggctgaggtaggaggatcacttgaggccagaagtttgagaccattctgggcaacaaagcaagaccccctctctataaaacacacgtacagacacaaattaggtgggcgtggtggtgtgtgcttgtagtcctagctacttgggaggctggggcaggaggatcacttgagcctaggagttaaaggctgcagtgaactatgattggcaccactgctctccagcctgtgcaacccagtgagaccctgactctaaacaaaacaaaacaaaaacattaaggaactcaaagaatgaaagcaaagagtgcttaacaacaacaacaacaacaacaacaaaagccaaaaccaaaaaccagaagtagtaggaagcaaggtaatttttgagagagaagaggcaggtagtggggtgagagatttgacacagccacagtagataatgagagagagttgagtggggaatttcagaaggattgtcaggcagcatgatccagatttttttttttttttttttttgagatggaatcttgctttgtcgcccaggctagagtgcagtggcatgatctcggctcactgcaacctctgcctcctgggttcaagctgttctcctgcctcagcctcctgattagctggaattataggcgcccaccaccattcccagctaatttttgtattttaagtagagatggggtttcaccatgttgaccaggctggtcttgaactcctaacttcaggtgatccacccgcctcagcctcccaaaatgctgggattacaggcgtgagccaccgtgcctggccaatccaaatattttggacagtgaatttatgatggcaccaatccaatgggttatttttctctagccacatctagtggtctagagttaggtagttgtactgagccagggttagggtttgcatatggggatgaaaggcagtggggcaagtgagggtatctgtaagagaatgattgaagtgaggaatgctggaatctcaactagatagggaaggagggtaaagtcaagaatgtgtgaataggtgaaaagtatgaggataaagagttttgagggcaaagaacaggttgtagtgaatgagagctggatagatagacttgtggtcagagagggcgatgtatgagtttcatattccagaggtacagcagttgctggtgttgacagggtctgggggatggtcatgagagttggtagctgaaatgggagtagaggtaacagtctctgaagatgagaagatcaaagaactaagtgcctggaatgttgtgtctccagatggatactgatttcatgtaggatgttgtcaggactcgggatggggaagatctgagcaggttcttcagcgagtgaaggggtgtgttggggagatgggtatgtggcagtgatgaagaggagtaggaagtggtatggctggatggtgtggaactcagaggagtgggagctcttacacaagggtagaggagagatgatctggaagtctcaccagagagtgagagggatggctacccacaacccagtcctgagttatgagggtatgggagaatgtgcagctataagggctctagcacaatgctgcttagattttctgtggcaaagaaccaaggcacttttaaaatttccaatctataatgggccgatccttttatgatataaaaaaagaattactagaaaaaaatggtatgaaccggccgggcgcagtggctcatgcctgtaatcccagcactttgggaggccgaggcgggcggatcacgaggtcaggagatcgagaccatcctggctaacatggtgaaactccatctctactaaaaatacaaaaaattagctgggcgtggtggtgggcgcctgtagtcccagctactcgggaggctgaggcaggagaatggcgtgaacccaggaggcagagcttgcagtgagccaagatcgtgccactgcactccagcctgggtgacagagcgagactctgtctcaaaaaataaataaataaataaaaatttaaaaaaatggtatgaaccaaaagacatataaaagacaagcccaaaattttattcttagattgaacggatataaaattattctgttaaattgctgtaaaaacttctgcataatagtgatgcttactcttactttctgtacttaccacagacctgtagtaaatagttcacagaccggcattagtctgtggaccacactttgagtggcaccggtgtagagaaaatgattttcccgtaggagaagctgcattcagttaagcctggaaggtgaaggagtgtttgttgaagagagtgccaatgttgagcagtttgtttaccaagttgggaaaggggatgagcagcgggtgtttagagtagagaaagcacatagccacatagggtgaaagtttaggggagagagaggtgtccagagggaacaggggtatgagatagaaagcatgcagtccagggaactgagttaatgctacaaggtctggggaatatctttgaagaagttttaggcaggtgaaaggtgaggtccggactggacttctagcacttactgtgaaaccggatacttactgtgtatcagactttatgctcactgtgctacacacattagtattatttttgtagagatggggttaccctatgttgcccaggctggtcttgaactcccggcctcaagcgatcctcccactttggccgcccaaagtactgggattacaggtgtgagctaccgcgactggccatgctgtgcactttatatacattatcttattgaatccttaaaaaccctacaaagttgatggtgatatccctagtttattgataagctgctggtttataggcatgagattattagttgggaatatatttagttgggatattgggaagattattagttgggaagtcctaatcccaggaagtccatttatgagcatgatcttggctgaaacaacttgagctctgccttaatgttctctgctgtgtgtggtaaaccaaacattttaagacttgggtcttctttttttttttttttttttttttggagacagggtcttgttctgtcacccaggctggagtgcggtagcacaatcatggcccactgtagcctcaatctcctgggttcaagggatcctcccagctcagcctccatgctcagctaaatttttttgtttgttttggtagagatgggggtctcaatttgttgcccaggctggtcttgaactcctgggctcaagtgatcctcctgcctcggcctcccaaagttctgggattataggtatgagccactgtgactggcctaggtgtttaattttagcaagaatttatttggagggctgctggtgccttccctagtaagggaaggttgaattttgtgagattaccacctcatatacatgcaaagtcaaattttcaaaattaagtaaatctttttaagtctttaaaatgtgaaataagcaacagatgtttattgtaggaaattagaagcacagataagataaaaaggattatctgtaatttttcatttagaactactgttgactataaatttttttttttagtctttttcgtttaataaagtatctcaagtttaaaaattaggttataaggctgggcgtggtggctcacacctataatcctagcacttcgggaggcagaggcaggtggatcacttgaactcaggagtttgagaccagcctggccaatgtggtgaaacctcgtctctactaaaaatacaaaaaattagccaggcatggtggcacatgcctataatcccagctaattgggaggctgaggcaggagaatcacttgaacccaggaggcagaggttgcagtgagccatgatcacaccactgcctaatacagtaacccctaaccacatgtggctgctgagcgcttgaaattttaaattttatttaattttaatggatttaaacataaatagccacatgtacttaatagctgttctactggacagcactgttctagacctcataaaaaataaaatttccataaaccttggctgtttttctctttttcagttgtgttggtgttgaagaggagaaggctgctgacattgacctctaccactgccccaactgtgaagtcttgcatgggccctccattagtaagtagatcttagggtttcctagagaagacaatccagaggagagacaaaggaaaggaaatttgggggagtgattgcttttgcctgagcacttgtgattcttcttcctcaggaaatagcagaagcctatgcaggctccacaggccagcacctatctcactaagaggacagaagttcataacttcacctccctcccttcctaaggcttatctagagaaagtacccatccatcttcaccaggaactttcctgaatctgtgagggcctcattgactccagatgctccaaggggtggttagattggaagagaaggatctgctgaggcctttgttcttggtatcatagctcatgaccgttctgactcacaatctctcatgtttttctggcttagtgaaaaaacgccgtggatcttcaaaggggcatgatacacacaaggggaaaccagtgaagaccgggagccctacgttcgtcagagagctccggagtaggacttttgacaggtgaggaaccctgcctccagtggctggtgaatgccagggctctgggaagctggaactcacctcttcccagctttcccagtggctgtcccattaggagcttccccagtttgtgagtatcttcagggctctgcaaattccttctggtttggtcaattcctggaaaacttctggtagttgggaggcagtattcacctaagttagatacttacattcatccaaggaatgctgactagaaggagtcttaggatcagaaagtttaattctctcatagagaagaagaaactcttttaatataaaaaaattattggtcatatatctcttttatgatcgaaaagaggttttatctttttaaaattaagctggccttgttaaaagtaaattacatgaaataagcaaaaataatgagttaaaaaaaggaacaaagcattctcctttgcttggttttttaattcagtagaccatgttcaggttttttaaaaataattgcaactggccgggcgcggtggctcacgcctgtaatcccagcactttgggaggccgaggcgggcggatcacgaggtcaggagattgagaccatcccggctaaaacggtgaaaccccgtctctactaaaaatacaaaaaattggccgggcgtagtggcgggcgcctgtagtcccagctactcgggaggctgaggcaggagaatggcgtgaacccgggaggcggagcttgcagtgagccgagatcccaccactgcactccagcctgggcgacagagcgagactccgtctcaaaaaaaaaaaaaaaaaaaaaaaaaaaaaaaataattgcaactttgattttagattcaggaagtacatgtgcaggtttgtttacgtgggtatattgcatgtgtgaggtttggggtgcaaatggtcccatcacccaagtagtgaacatagtacccagtagctagtttttcagccccttccctactacctccctcccaacttgagtggtccccagtatctattgttcccatctttgtctatgtgtacccaatgtttagctcctacttaaaagtgagaacaaaagcagtatttgattttctgttcctgcattaattggcttacgataatggtctccagctgcatccatgttactgaaaaggacatgatttccttctgttttatggctatgtagtattccatgatatatatgtaccacacttttctttatccattccactgttgatgggcacctagtttgattccatgttttactattgtgaatagtgctgcagacatatcagtgcattcgtctttttagtagatggtttattttcctttgggtgtaaatccagtaatgggattgctgggtcgaatggtagttctcttttaagttctttgagaaatctccaaactgctttccatggtggctgaactaatttacattcccactaacatggtataagtattccctttgctctgcaggcttatcaggatctgttatttttttttttacttcttttcaggttttctgtaaccaaagtgttaattggaataagtgttccttcaacttaatgtttcttgttttatttgtttatttaaaggcagaaacttctcctctctactctggactcctcaggttctttctccaaagtcaacccgttatttgtagatcctttcagaaatggtttttgcatatacaaacatagatttttttaattcctttttttgacacaaatggaaacaactatatattgttctgtatcttgcttttttttaaaaaaatatatatttgagatcaatccataatagcacatacagatgttctttttcatggctgtttaatattacattgcatggtgtaacatttatttaaccagtcctctactgagggacgtttaagttgattccagtattttgctattagaaagaaatactgtaatgaatatctttgcacttaagtttttgcatacgttgccagttacatccatagtggctataccatttcacactcccacagataatgtgcggagggtgccgattttcctatatcctagccaatatttgtttgtttgtttgttttattttatttatttatttattttgagacgatgtctcgctcttgtcccccaggctggagtgcaatggcgtgatctcggctcactgcaacctccgcctcctgggttcaagcgattctcctgcctcggcaccccgagtagctgggattactggcgcctgccaccacgcccggctaatttttgtatttttagtagagacggggtttttaccatgttggccaggctggtcttgaactcctgacttcaggtgatccacccgccttggcctcccaaagtcctgggattacaggtgtgagccaccgtgcccagccaccaatattatttattatcaattttttttttgcctttctgataaaataaatcgtgaaatcctgctgttcccacttgtacttcttttctttctttcttttttttttttttttttttgaggcggtgtcttgctctgttggctaggctggagtgcagtggtgcaatctcagctcactgcaccctccgcctcctgggttcaagcaattctgcctcagcctcccaagtagctgggattacaggcacgtaccaccatgcccagctaatttttgtatttttagtagagatggggtttcaccatgctggccaggctggtctcaaactcctgacctcaagggatctgcccaccttggcctcccaaagtgctgggattacaggtgtgagccactgtactcagctcacacttgtatttctttaattatgaaggaaataagtagattttttttttgagacagggtctcatttgagacaggctggagtcgggtggtgcaatcaccactcactgcagccctgacctccctagcttaatccatcttcccacctgcgcttcctgggtagctgggactacaggtgtgtgccaccacgcccagctaattttttttttgtattttttgtagagacggggttttgccatgttgcccaggctggtctccaactcctgggctcaaacaatctgccttccttggcctcccaaagtgctgggattacagttgtgagctattgcactcagccttagatttcatacatttataaaccagcttgattgttttctctgtgaactacttgcttgttttataggcattctgttgtgttactattactgatttataacagctttcttggagaaaattttaatttctatatggttaagtttattactatttttaatgactgctgggtttttcccaggtttttctactcttaaagctttattttttggaatttaatctttggaccatctaggattatgtaaagaatgagataggcaggccaggcacagtggctcatgcctgtaatcccagcactttgggaggctgaggcgggcagatcacctgaggtcgggagttcaagaccagcctgaccaacatgtagaaatcccctatctactaaaaatacaaaattagctgggcgtggtggcgcatgcctgtaatcccagctagtcgggaggctgaggtaggagaatcgcttgaaccctggaggcggaggttgtggtgagccgagattgtgccattgcactccagcctgggcaacaagagcaaaactctgtctcaaaaaaaaaaaaagaatgagataggcattgagcttgagcttaatatatttgtcccaacacaagttgtcagagttgtcaaatacaaatctttcctccaccatgatttaaaagaaaactattttctgcaccatgatttaaagaaaactattttctttcttttctttaaaaaaaaaaaaaaaaaaaagacagggactctctctgtcacccaggctggagtgcagtggcatgttcaaagcccactgtaacctcaactcctgggttcaagtgatcttcctgcctcagcctcccaagtacgtaggactgtaggcctgcaccaccatgccctgctaattttgaatttttttgtggagacgggtttagaaatgatgcccaggctgaaactcattaagtatgcacgttgagaaagttgttgtatatgcatgttgagaaagttgttgtaaaaatgttgttgttttgtttaaatcagtcttttctctttgacagtgttttaaattgggtaatgctgctcttggtttgaacaaatctgtcaaacttgtcagatgtgtcttttctttctggccaggctgttgactgatttcttcttgtcacccagagaagagcaccatgttggcagaatactccccacctctgccagtgacctggtctcttgccttggacagatcatttcttccctggcagatgaggtttttggcattagttgccagctcacattaagtcccctcataaaaaccccacctcttgggtgagtggcagcctccaataaggcctttagtgggcagggcctcaggctcaagctttctctcctgcggcccacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggtaagacactacagacccttttaactgtaacattgttcattcctgtcaagatctgtgtcccttcccctccaatctgtttttgcatttcctctgtaaccatcttgggaatctcaggtgaaatgccttgtccaaagtcattctttggcagagatagagtcaaaatcctagtctcctctttgttctcctttcatgcattcactcattcgtttatcagagacagggtctcgccctgttgcccaggctggagtacagtggcgcaattaactcactgcagcctccacctcctcctgggctccagggatcctcaaacctcaacctcctgagtagctgagactacagggatgcaccaccatgcctagctagttttgtttattttttgtagagatgatgtcacactatgttgcccaggctgatctccaactactgggctcaagcgatctttctgcctcggcctcccaactgggattacaggcgtgagccaccacgcccagccccttctccttttaatagtccataaaaccccaggttgagctccgttttttacctgggaagttctagggatcattgtctgtcttctgttgaaatgagaaagcttttgactgttgttctcacatgccacttgttgtctgggcatgagtttctggggagaggaagagaagaaatggagaagcaaggcccaggcagatggactactatgtgtgaggctgtgtgtctggtagttccattgccctagcagggcacatagatctaaggaaagtgcgatgggttccttcccctgccccccaaacaaacacacacatatatgtacagtgtcagtggagagaagctttgagtgtaaggccattctagggactgatgaggggacaagagagtcttccacagtccctgagactacttggtgcagaacctatctctttactccaggttctgacaaagagattgatgtgattgatgtgacccgccaggctgactgcaagatgaagcttggtgattttgtgaaatactattacagcgggaagagggagaaagtcctcaatgtcattagtttggaattctctgataccaggtaagaggtgcaggaataacaaaaaaacctgacaaagtgcctgaaacttgtgtgatatatctagtgtatattcgtgtttctctctctttttttttttttttgagacagagtcttgctctgtcgcccaggctggagtacagtggcacgatcttggctcactgcaacctccgcctcttgggttcaagcaattctcctgcctcagcctcctgagtagctaggattacaggcgcccgccaccatgcctggctaatttttgtatgtttagtagagatggggtttcaccatgttggccaggctggtctcgaactccctacctcaggtgatctgcccgccttggcctcccaaagtactaggattacaggcatgagccaccgcaccttgcctcgtgttcctttctcttcttcctggtggtttcttcctttgggatggcgagctgggttatattttctagggtagctgctcacgttgtaacagttgagtcatatttctcctccacagtttctagcattggatagattacatagtagctattttaattaatttttgtctcctttttcaagaccttaggacacccttctttgaccttttcctcctatatacaacagtgccacagtcactgtgtaactggtgggataggtcctcagttcctggaaatagatttactaaaattacccccatgtaggtttcttacatttaaaaagaaaaagagaaacctatttacctttaaatgattctatctggactcacacacacagtagatacgtatatagtcttctctttgggtcagaaatgtgggaaataccaagaaatcataatgtatctttttgcccttaggaaacttactgtctgattatttacatttttaacttttaatttgtagattgataggaagttgcaaaaaagtgtacagggaggtcctgtgtactctttagccactttccctcaatggtaacgtattatgtaattacggtacaatattaagacccttgctgttgtgttttttttttttttttttttttgagacggagtttcgctctgtcacccaggctggagtgcagtggcatgatctcggctcactgcaagctccgcctccctggttcacgccattctcctgcctcagcctcccgagtagctgggaccacaggcacctgcgaccacacccggctaattttttatgtttttagtagagacggggtttcactgtgttagccaggatggtctcgatctcctgacctcgtgatccacccacctcggcctcccaaagcgctgggattacaggtgtgagccaccgcgcccggcgctgttgtttttaagatgcaaggttaaacaacctgagagtgtttaaaaactgtatttgtttgtttatacttcacttcatcctgaaagactattcaaggtagcttacagagatgtggagaagccaaaaaaaaaagagagaaaactagaacaaaagtgaaataagattgggaaatagaatgcatgtggtgggtgctcagcacatttcccggttggtggaaatggactatagagttttcagtgaatttcctgaaggtcagaacaaagagaggagtgcagtattgtaagatttgtggctttacgtaggataaaagcaacagatgtttcagagaaacatttctttacctggaactgagccctgtgaggttgctctagtggtttctcataaagaagacactatgagatggggatagtgcaataacttctataatccacatgccaagtgagtagtctggagtggggctggggagtatgagcatttagtggaggaaatgaacacctttgactggagaagcctgtggagcttggacttgggacttctggagatgagtagaatgaggatactgaccagacttacagaacagaaataagtgtcctatgtgcctttggggattctgtggagggaacttgttctctgacttatctgaccctcactgaactgtggggtattttattcaggcctcaatcttctcttcctaatcagctgacatctgctctccaccccttccttggtagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaaggtaggaatgcgcatggcttctggaggcagccaggccttgggcctccctgtacgtgtcacatggcagcacagaaacattttgaatcagtttgatttacattttgaataaaaaaaatttgatttggccgggcgcggtggctcacgcctgtaatcccagcactttgggaggccgaggcgggcggatcacgaggtcaggagattgagaccatcctggctaacacggtgaaaccccatctctactaaaaataaaaaaaattagccgggcttggtggcaggcgcctgtagtcccagctacttgggaggctgaggcaggagaatggcatgaacctgggaggtggagctttcagtgagccgagattgtgccactgcactccagcctgggcgacagaacgagattccatcttaaaaaaaaaaattgattcaaaaatgtttgacgaatcaaacgtttttgaataatagcagatgcctgaggttttcctggttgttaccttcttttttgttgttgttgaggcagagtaaaaacaaagattttatttatttatttgagatggagttttgctctgtcacctaagatgacagttgccagtgctggactgcagtggcgtgatctcagctcactgcaacctctgcctcccgggttcaggcgattcttctgcctcagcctcccaagtagctaggattataagcgcccaccaccacgcctagctaatttttgtatttttagtagagacggggtttcaccatgttggccaggctggtctcgaacgcctgacctgaagtgatctgcttgcctccacctcccaaagtgttgggattacagtcgtgagccactgcacccagccgttcttaccttcttaattgaaccagtttatactcatatcagcatgtatggaaatgtccacatttactttggaaattcctggtaacatgagaaacttccctttctccaacattattgaggtataatttatatactataaaattcatccattttaattgtacaatttgatgaattttgtcagttgtatatagtcatttaactgccaccacagtcaagataaaacctgtatgagaagtctttttaaagtcaggatttccatagtttcatttttagtaattgttacaattttgtaattagtgtattgtcagtgactatgaaggatttttgaggtctggaaaacaaatttcttaaatgattttggttttcaccattgttcagattatttagttttcttttttattattattatttttttcttagaaacagaatctgtctctgtcacccaagctggagtgtggtggtgcagtcataactcactgcagcctctcactcctgggctcaagggatcctcccacctcagcctcctgagtagctgggactataggtgcatgccatcactcccagctaattttttttaccttttttttttttttttttgagacagtctctcactttgtcacccaggctggagtgcagtggcatgatcatggctcactgcagcctcgacctgctgtgcttaagctgtcctcccacttcagcctcccaagtagctgggactacaggtgtgcaccaccacttctggctaattaaaaaaaattatttttgtagagactagctctcactatgttgcccaggctggtctcaaactcctgagctccagcagtcttcccaccttggccctcaaagtgctaggattacagacgtgagccactgtgtccagacaatttttttactttattttttgtagagacagagtcccactgtgttgcccaggctggactcgaactcctgggttcaagtgatcttcctgcctcaacctcccaaagtgctgagatttcaggcttgagccaacatgcctggcctagttttcttatcagaaaagtcaaaggaaagaatggaaaacttggattgtggctcttgtccaagtgatcacaagtccttacctagttgtttccattggtttatcatttaggaagtagaatgtgtaaatgaaagtgctattatgcaaatgttaggtttaactcttttattttaaaataatttcattttatagaaaagttaaaaaataatgggaagaatgtctgtctgcccttccctgagattcctcaaatgttaccattttattatattctctctctaaagcaaacacaataaaatggttatatatatatttttttcctgagacatttgtgcgtaaagacataatatttctttatatcttaataattcagttgtagttcttaactacaagtttgtcttaaaactttgtcttaaaaacaaagacaaagtcttaaataatttgtatagttatcaaaatcaggaagttaacattgatatactagtacctaatctacagacctgattcaaaattctccggttgtacacctgatatttctagtgttacttttctacattgaaatttattatcatgaaatactggttaaaccaatcatgctgtgagaatatatttgtgctactgggtttttgtttctttctttttttttttttttttttgccaaattatctttctggtgtttatccaggcaaaacacaattaggaaataaatgttcttccaaaagataatcacataacatataatcttccagaagtccttgggcgattactgaacttttaaacttttattagctttgattgcaggtgtgggaaggaacactctgtaaatggcatttgaaggcaaattcaattttcttctcatcagtaatgtggccttaaattctcctaaggctactagtattgatctactcatctgtagaggccattctttatttggcattgtgtctaaaataggaacacttggtgtacatatgtcttaacttgaacaattttgtttgaaatgccctttccaatttgtttttgtcaagtttatagaaacttaaaagtacaaaaagcaaagtgaccttttgaagttttccaaatccacaaagaaatgataattggatgggtttgggcaagaactctggcatattgccatcgttttggagcatgggagaaatacccctttggagtacccgttaaggacttttctggaaacccttggtatttttgtcacttcaacctctttttgtttcagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacaggtcttcccttgggtgcttctgggagggtttggggagggtggaaagaagaagggagcttttggccccacagcatattaatctgattacgtgggatgtctttctcatatcagcgaaaggcgcagaactgggcttcaagaaatttcatgtggtagtcagtgggcagcatggtcacctggggaggctgaaagtggggaatgtccaggaggaggctgatggacttctttgtcctgggttgatgtcatctgggtgaacagagaacatgactctaagccccgtaactctagggatagtgcctgggaggctggcattctaggctctaagtcagaatgacctgtggtggggatagtgctttttttccctaaacagtttgtacctgggcttcactcttagaattatgaattcttaggtcttgggtgggatctgagtatatttattgtgaaaaaatcccccagttgtctcaatttggggagagttgacatctttacttgattaggtcttatatgaatacagggtatctctccatttatttagattttctttgatttctttaatcagaattagtgttaaattttcttaaaatgtatagtagaattctctagtgcaatcacatatgcctggagatttgttttcttgggaagttttaaattaacattcaatttaaaaaatctttaaggttattcagattttctatttcatattaaataagttgcgatcatctgctcttcaaggaattggtctatttaatctaaattgtcaaatatatgtgtggagttgttcatagtgttttcttttttttgagatggagtttcactcttgtcacccaggctggagtgcagtgatgcgatctcgtctcactgtgaccactgcctgcatcccaggctcaagagattctcttgcctcagcctcctgggtagctgggattacaggcttgcactaccacgcccggctaatttttgtatttttagtagagatggggttttaccatgttggccatggctggtctcgaacttctgaccttgacctcaggtgatccacccgcctcagtctcccaaagcgctgggattataggcgtgagccaccgcacccagccatagtattttcttattacccttttgatgtcttccaagtctctagtggtattctttgtatcattcctgacgttagttatttgtgctttctcttttgtttgtgtcaattttctataggttggtcaattttattgatctttccaaagagccactttttttttttttttttttttttttttttttttttttctgagacagagtctcactctgtcacccaggctggagtgtagtggtgcgatcccggctcactgcaacctccgcctcccaggttcaggtgattctcttgcctcagcctcctgagtagctgggattacaggtgcctgctgccacgcctggctaatttttgtatttttggtagagttggggtttcaccgtgttggccaggatggtcttgatctcctgacctcatgatctgcctgccttggcctcccaaagtgctgggattacaggggtgagccaccgcacccggcccacttttggttttattgatttttctctgttgtctttttgttttcagttgtgttgatttctgcttttatctttatttttccttccctctgcttgctttgggtttattttgttctttttctagtcttgagatgagagcttagtttattgatttcaggctttccctaaatttccctctcagcattgatttaggtgtgtcacacaaatattgacatgttgtattttcattaagttaaatgaggttttgaaaaattgagatacatcttaaatattgtaaaatttaccattttaaagggtacaattcagttctttgtatatttacaaggttgtgcaacatcactgctatttaataccagagaatgttcattatgttatttatctcctttttgagatggagtctcactctgttacccaggctggagtgcagtggcacaatctcggcttactgcaacttccgcctcccgggttcaagtgattctcctgcctcagcctcccgagtagctgggactacaggcttgtgctaccacacccggctaatttttgtgtttttaatagagatggggtttcacccatgttggccaagctggtcttgaactcctgacctcaggtgatccacccgtctcagcctcccaaagtgctgggattacaggcgtgagccactgtgcccggcccgaatgttcattgttttttaaaaaaaccctatactcattagcagtcactctttattcatttgtctgccagcccttgacaacccctttttcacttcatttgtgtatggatttgcccttctgaatatttcatatagatggaatgttgtaatatgttgtcttttgtgtctagcttctttcacttgtaatgttttcaagaatcatccatgttacagcatttatcagtatgtccaggctggagtgcagtggcgcgatcttggctcactgcaacctctacctcccaagctgaagcgattctcctgcctcagcctcctgaatagctgggattacaggcacctgccaccactggcctgggtaatttttgtatttttagtagagatggggtttcaccatattggccaggctggtctcgaactcccaacctcaggtgatccacccacctaggcctcccagagtgctgggattacaggcgtgagctactcctgctccctggcgagtgcatctttttttttttttttttttttttgacggagtattgctctgttgccaggctggagtgcagtggtgcagtggcgcgatctccactcactgcaacctccgcctcccaggttcaagcgattctctggcctcagcctcccgcatagccgggactacaggcatgcgccaccatgcccagctaatttttgtgtttttagtagagacggggttttaccatgttggccaggatggtctcaatctgttgaccacgtgatctgtctgcctcagcctcccaaagtgctgggattacaggtgtgagccactgcgccgaccacttcgttctttttaacagctgaataatattctgtggtgtggatatgccacattttgtttatccattagtcagttgatagacatttgagttgtttgcactttttggctgttatgaatagtgttgctatgaacattcgtgtacgagttattgtgtgaacgtaagttttcatttctcttgggtatatatctaggaggggaattgctgagtcatatgtaactctgtgtttaactttttgaggaactgacaaactgttttcaaagcagctacatgtaccattttatattctcaacagtaatgtatgagaatttcagtgtcttcacatcttcccccaatgcttattgctgtctctttatgattatagccatcctaatgggcgtaaagtggtatctcattgaggttttgatttctgttttctggatgacctttgatgtttaacatctttccaaatgttcattggacacttgtatagttttttttggagaaatatctatttaaatcttttgcccattctttaattagattgtctcttcattgttgagttacaagaatttatatactttggatactagacttttaccagatatgtgatttgcaaatattttctctcattcttggggttgtcttgtcacttttttgatagtgtcctatgaaggacaaaagttacaaattttgatgcccaatttatctatttttttttctttatttgcttatgcttttggtgtctaagaggcttgcttaattcaaggtcatgaagatttatgcctatgttttcttctaagcattttatagttttagttcttacatttagatctttcatccattttgatttatattgattttgtgtatggtatgaggtaagggtccaatttctttcttttgtatgtagttctagttgtcccagaaccttttgaaaagactgttctttccccattgaattgtcttgacacctgtgtcaaaaatctgttgaccaaagataagggtttatttctggaccttgaattctattctgttgatccttctaacagtgtcacaccatctcaattattgtacatttgtagtaagttttgaaattgggaagtgccagtgctccaactttttctttttcaggattatttggccccttgaatttttttttttttttttttttgagatgaagttttgttcttgttgctgaggctggagtgcaatggttgcggtctcagctcactgcaacctcagcctcctgggttcaagcgattctcctgccttagcctcccgagtagctgggattacaggcacccgtcaccatgcccggctaattttttcgtatttgcagtagagacggggtttcaccatgttggctcagctggtctcgaactctagacctcaggtgatccacctgccttggcctcccaaagtgctgggattacaggcgtcagccacagggcccagccggtcccctgaattttcataagaattttttggttcagctttcatataggttttctagttattttgtagtgtttgctctaattattactttatacatacatagcatatcacagtctactagtatttacatattacctgtttgagggaagggttgaaaccatacctcttttttttgagacagaatctcattctgtcacccagcctggaatgcagtggtaagatgacagctcaccacagccttgacctcccaggctcaagcaatcctcccacctcagcctcccaagtagctgggaccacagatgtacactaccacgtctggctgatttttttagttttagtggagatggggttttgccatgttgcccaggctggtcttgaactcctgagctcaagtgatccacccacctcggcttcctaaagtgctgggattataggcgtgagtcaccgcaccgggcccaaaaccttacctctttttacatccctttatccttcgcatttttctacaattagtcatgttttacatttttccatgtatttgtcttaaatatttctcttcatacattgattatgagattgacgtgctacccactacaccaagagggctactatcctctgcgtatgttgagaactgtatcacaaagttttataatttttgctttccctatgaaacataatttagaaaactcaagagaaggaaattctatggtattcacccatgtttttactcatctgtttattctgttttcctttctggtctttagagtttcagggtaggtctactgtcgacaagttcttagtttttttccatcagtaaatgtcttgattttttttttctttcattcctgaaggatatttttctggatatagaactctgggttaatagttcttttctttcaacacctaaagaatgttttgctgtttcgttctggcctctgtggtttctgatgagattttggctatcatctgaattgtttttcccctatagataatgtatcatttcttgatgctttcattcttttttttttttttttttaagttttctgcagtttggccatgctgtgttttttttggtgtggatttctttgggtttataatgctgaatgtgttcactgagcttcttgaatgtgtaggtttatgtcttttgctgtatatgtgaaatttttagccattatttcttttcctttttttttcttttctttctttctttcttttttttttttgagagggagtgtcactctgttgctcaggctggagtgtagtggagcgatctcggctcactgcagtgtccgcctcccgagcagctgggattacaggcatgtgccaccatgccctgctaatttttgtatttttagtacagacagggtttcaccatattggccatgctggtcttgaactcctgacctcaggtgatctgcctgccttggcctcccaaagtgctgggattacaggcatgagccaccgcgccaggctgccattatttcttgaaatacttttttagactcatgctctaacttctgctggatctctgattacatgaatgttttgtatcttgtcttagtcccgcaagtccttgagtttatttttctgtgtcttttttctctttgttcaagttcagattgggtaatttcggtttctctgtctttgcattttctgtttctttcttctgttgtctccattcttctgttgagtttgtcaattgcattaattttagatacagtatttttttttttttgacacagagtttctctctagcacccaggctggagtgcagtggcgtgatctcaactcactgcaacctctgcctcctgggttccagtgattctcctgcctcagcctcccaagtagattacaggcacgcaccaccatgcccggctaatttttatatttttagtagagacagggtttcaccatgctgatcaggctggtctgaagctcctgacctcgtgatatacccacctcggcctcccaaagtgctgggattacaggcgtgagccaccacagctggcccagatacagtacttttcatttctaaaattttcttttgtttcttgtgtatttctttgctgagaatttctatttcctatttttgtgtcaagcatgtttggaattgctcactaaggtattcttatgatgatttcttatgatgatttctttcaaattcttgttacataattctatatttgtctaaccatatattgtcttatatatattggattgtctattgttttacaagtctgtttttctcttcaattatcaatattattgatacgatttcattggttttttagaatgtttaatacatggtgaggcaggtcattcactcccacccaactcccacccccatctgcttttctcttttatagttttctgttcccaggcatttattcatccatctttgaatcctttgcctggtctagtccataatgacttttctatactgggcatttagtaactgatggattgaatttgcccattagcggtttgagttaattaattgacatcttggtagaaatgcccacacaccgggtgcaatctacttagggccacaagcattgagtgtctactgtgtgccctggtattgggctaagtgctaaggacaaaagattgataggctgtttcagtataatattctactagccacaatagcaccaataggggtattcaccactagttttggaagcacagagaagagtgcttagtctagccataggtttgtgaaagtcttaggagagcaacactagaagggtgagtagggattaactatgaaaagaaagacaggaatggcatttcagacatagggaaaggtggaagaaaaccaaaactgtgtgaagcagcttatggatactagagcttaaagagcaagggctggggtggatgaaagtgaaaaggtaggccgactgaacttaccacagaggcgattgagggccattgaaggtttatttagtttctaatgaaatatttcagatgtaccaaaagatataaagaacaatataggccgggtgcagtggctcatgcctgtcgctgaggctggagtgcaatggtgcgatctcggctcactgcaacctctgcctcccgggttcaagtgattctcctgcctcagcctcccgagtagctgggattacaggtgcctgccaccatgcccagctagtttttgtatttttagtagagacggggtttcgccatgttggtcaggctggtctcaaactcctgacctcaggtgacccacccgcctcggcctcccaaaatgctgggattacaggcatgagccactgtgcctgaccctaatttatattttagatatatcgcttaggaatggatgtgaaggatagatttgagattattgtagagcagtggtttgcaaacagtcggtattcctttatactcttaaaaactattaaggacccagaagagctttttattatgtggtttatatttatcaatttttaccatataaattaaaatagaaaatttaaaagtacttgttaacttattaaaaaataattataagcccattacatgttagcataaataaaattttttttatgaaaactgttttcaaaaatgtttagtgggaagaatgacattgttttacatctttgcaaatctctataatatctaggttaatcaaaaattgttagaaccccagatctgcttttgctttcattctgttggatgtcacatcatgtacttcctggaaaactccactgtatacccatgagaataagggtgaaaaaggcaaagaacatcataatattctcatgaatatagttctgagtggcatctcagcttctctcaaagagtctcagggagcctaaggattccttggaccacaccttgagaacatctggtgttgggaagccagtttggaggctaactgctcttaaggagttgggtttgagatgagtaggtagtggagataatcagaggaagaaaggccctcttccagctttgattttgccttgttacactgcagggtggatccatgctgtgctgacgcctgtggactgccttgcctttggagggaacttcttacacagccttaacatcgagatgcagctcaagtgagtactgaaactgtggtgattctatgttggccattcctgtctgctagagtgaggagtataatgtagaaggaggggacatggccagaaaggaatggttcctcgttcctgatcatgttcagctgaagattaacaccttttctgcacttagtagttatttgactttgggcaagttatataacctttgaacccaagtttcctaatgtgtaaagtcagatcttgcagagtcattttgaggattagagatacaaagcatccagaacaaaacctgattcatagtaggtgctcagtaaatgaatccttgtttttgttgttggtgtttcctccttctagagcctatgagattgagaagcggctgagcacagcagacctcttcagattccccaactttgagaccatctgttggtatgtgggaaagcacatcctggacatctttcgcggtatggagccctttgccaactgtcctttttgcccctctcccctgagtgaatgagtatgtgtgtatgtgtaagtaacgcagtcaagacatgatactatttcattaccagaaagatctcagtatataaattaaaatcatgttgtgtaccgtaaatatgttcaatttttaaaaagtgataattagtgctttaaaaaaaatctccctagtgctacccgcccagccccgagccccttcttttttgagataggatttcactcagtcacccaggctggagtgcagtggtgtgatcatggctcactgcagcttcaaactcctgggctcaggcaatcctcctgcctcagtttgccgagtagctaagactacaggcatgggcccccacacctggataattttgtaaattttttgtatgaacagggtcttgttatgttgaccagattggtctcaaactcctggcctcgagtgattctcccacctcagactccttttgctggggttacaggcatgagccacagtacccagcaatgctacccctttatagtccctttatagtttcacccactctcctcccttgtaccatccgtaacttctggaaaccactaatctgttttccatttctataattttgtcatttcttttttctttttttccgagacacagtctcactcttgtcacccaggctggagtgcagtggcgtgatcttggctcactgcaacctccatctcctgggttcaagctttgcctacctcagccttctgagtagctgggattacagacacccgccaccacactcggctagtttttatactttttttttttctttttcttttttttgagatggagtctcgctctgtcaccaggctggagtgcagtggtgcagtctctgctcactgcaaactctgcctcctgggttcaagtgattcttctgcctcagcctccagagtagctgggactataggcacgcgccactgtgcccagctaatttttgtatttttagtagagacggggtttcaccatgttggccaggatggtctcaatctcttgacctcgtgatccgcccgcctcagtctcccaatgtgctgggattacaggcgtgagccaccacgcctggccaaatttgtcatttcaaaaatattgtataaatggaatcattatagtacgtgaccttcttagattcacttttttactcagcataatacatggcaaggcatggattttaacctttttgtttagcaagtgtgactgaaaatattggatcacagtgaaatgatctctatttcctgctggttaagataaaaagttcaatttggatagtctgagagtttcctggatctgcttcccctggggataaggcccagtcctgaccgtcctggcatcattgttttggttcctgggcgttagcccagttggaagccactttacttactgggtttcctctttccttgtctgatccagaatagaatgggtcccttacttaggcctgagattcttcaagttgacttggccaggagaaatcagtattgatgagttataaagaatctcaggggccatgagtacagcctcgtagccaatacctcaagctcttattctgccacctagactgtcacttaagtgttcaatcagatgctggatgactaactgctcattacttattctaaacagcttggttcagtagaaaattatttatagagcctaaatctggctgtttgtagtagcctcctgacataaggcagaacacagctaatccatcttctacattaatggcccttaaagtctgtgtaggtagagctcatagtcctcctgagtgttctcattttgaaacccaggaggcacagtaatgtcatggaaggggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagtcccaagtccttcactttcctgcatggctttgttgacactctgctttcctctttcctcctttaggtttgcgagagaacaggagacaccctgcctcctacctggtccatggtggcaaagccttgaacttggcctttagagcctggacaaggaaagaagtaaatatgcatatttctctacctcctctggagttttgccctttgtagggactggatttgggtagatgttttggagagacagaagagaccagagaagcttgtgggctcctgggtgtagagtggaggtgtgggctaggattcctttgattacattttaaaatctttctttctgatgataaaaagtaatacaacatcacactagagaattagaaaaatgaggaaaagcataaagaaggaaaattatcacctatgatttttacactcagcgggaactgctattaacacttgtgtacatttccttctggtcttttttatgtgcattttaaaaacataattactgtcacactgtgtggttgacccttgaacaatgtggaggttggggtgcagaccctgccccccaatgcagtcaaaaatccacatataacttttgcctccctaaaaccttaactgctaacagcctactgttgaccagaagccttaccagtaatatagtcaacacatattttgtatatgttatttgtgttgtatactgtattattacaataaagtaagctgaaaacatgtgtttactgttcataaagtggaaatgaatcctcataaagggcttcatccttgtcttcacatggagtaggctgaggaggaagaaaaaggagaggggttggtcttgctgtcccgggtggcccaggcagaagaaaatctgcatataaacggacccatacatttcaaacccatgttgttcaagggtcaactgtatatccagttttgtgtttgaatctattggtttgtcttaattttcctgtgtcaccaaagttctccagaaacatttaatagttatgtgatattcttttgcaggaatgtaccatccttgcctaactacttgcttattgctgcttcctttttatttctttgaggggatagttttaaagaatcagacagtaaatatcagtctttgtccctcatttcttgattgtttcttcaggatggattcctggaagaacaattactgaatcaaagtatatgaaaaaatgtaaggctcttgatgcatactgccaaagtgggttttagaaatgtacaaatgtccatttatccaactgaacattaatcaactataaaaaaaaataagaaagctctgtatgtactgatttggaaagatctccaaaatttgtcaaggtgcacaaccgtgtgtatagtgtgccactttatatgtaaaaaggggagaaataagaattatgttagtatatacttgcctggatatatgatctgggatgtagaaactaatgaaaatggttacctgtgggagtgggatgatgggattgatggcaggggcagggtgggattgatggcagggacagggtaggaatgaagcttttcaatatcattttattttattttattttattttatttatttatttatgagacagaacctcactctgtcgcccaggctggagtgcagtggcacgatctcagctcactgcagcctctgcctcccaggttcaagcgattctcgtgcctcagcctcctgagtagctgggattacaggcatgtgccaccacgcctggctaatttttgtatttttaatagagacggggtttcaccatgttggccaggctggtctcgaactcctgacctcaagtgatccatccacctcagcctcccaaagtgctgggattacaggcatgagccaccacacctggcctgcctttcttttctaatgtaagcctttagctgttaatttccttctcagcaccaatatttgatttttgacctatgtgaacgaattaacttttcagaatactgaatttaaaaaacacaccaagaaatcaagagaagaagaaatgtcaacatgtaatcttaggcttcagatactccctttcctgtgtatactgtgaccaaaggtcactgcactgcaggcttaacttgtacaatctccttagttcctgttgccaaccttcccctcggatattcttggatttcatattttgagccttcccttgctccctgggctcacctacacctggaccttagcctgtgattctgtttctccacacctctcaggtgtggctaccttgggtttcatctctgacacctcccatggagtgaactttagagtgactgtgtcccaaaaacaccaaaagggaggtgggtgtggcccaagcactcatgactcaggatggacccagggaccaagggatggccccaaacagagtgatcagtgggagctggagtagagtagaacacagttctgagaagcccatgctcatggaaggagtcttttgtgaagtgcagatgatttgtaggggaggaacctgctccctcacctttccagagaccctggtctgggaaggaggaagccataagattatttagctgggtcacatggattctcagctccccgcctagccaccaaaataaattccaccagatagatgaaaagagttaaagggaaaaaagagaattaaaccatgagaaacaaggaaatgctgaggaattttttatcagccctctggatacagaaatgaagtgaaaagtggtagaaaaaaaatcacaaaggaagaaaaccttgagatctacataaaaatgtaaatctcggtactcaaaaagagggcaaacgaaagagagacaactaacagggatcgctctgggttgctgttgagctagctgtgggccagcagctgctcagcacagagttctttcctcacaagtggagaggctggtttgtccccactgatctccctgaggtccttgacttttttgaggggtgtggcccaaacccacaacttagttcctaataccttttgatactcttttattagatagatgttttacaaatattttctctcagtctgtgccttacaaagtagcagaggtgctgaaatagaggtttttcaaaaaagttttgctttttaagtccagttgatcaacttttttcttttctggtccatgcttatgtcctatctaagaaatctttgcctaactgaaggccacaaagaactcctcctctgtctaaagcaggggtttccagccggggtgcagtggctcacgcccgtaatcccagcactttggaaggccgaggcgggtggatcacctgaggtcaggagtttgagaccagcctggccaacatggcgaaaccccatctgcactaaaattacaaaaattagccgggcgtggtggtacgtgcttgtaatcccagctactggggaggctgaggcatgagaattgcttgaacccaggaggtgaaggtttcagtgagccgagaccaccacaccactgaactccagcctgggtggcagagtaagactctgtctcaagaaaatagtaagaagtaaataaaatatagcaagggtttccaaccttttggcttccctgggccaccttggaagaagaattgtcttgggccatacgtaacgatagctgatgagctaaaaaaaaaaaaaaaattacaaaaaatatcataggctgggtgcagtggctcatgcctgtaatcccagcactttggaggccaaggcgggtggatcacctgaggtcaggagttcgagaccagcctggccaacatggtgaaaccccgtatctactaaaaacacaaaaaattagctgggcgtagtggctcactctagtcccagctactgtggaggctgaggcaggagaatcgcttgaacccgggaggcgggggttgcagcaagccgagatggtaccattgcacttcagcctgggcaacaatagtgaaactccatctcaaaaaaaaaaaaagtctcataatgttttaagaaagtttgctaatttgtgttgagttgcattcaaagccatcttgggcagtgggttgggcaagcatggtctaaagggtgtatagttttaggttttacatttaggtctatgatccattttaagtttgtgtttgtgtgtatggtgcaagatagggattgaggtttgtttgtttttgtttttttttttgcatgtggatatccaattggtccagaatcatttgttgaaaagactactctttctccattgaattgccttggcatatttgtccaaaatcagttgtctctttatgtgtgggtttattcctcatgcctcttgtttgacaggctctgccagaccatgaggatgagatcccggagacagtgcgaaccgtacagctcattaaagatctggccagggagatccgcctggtggaagtaaggagcatggggcagggaagaaaaggcatttggaaaggccttgaggctcaagtggcaggttaggcctctgcagttagcatgagagcccaggggaagggtcgggaagaccctaccaaagacccaattcattcgttcaaataattattactgtgtttcaagtgtgccgcacattgggctaggctcttaaaatacgtaaatagtgcctgcccacaaagaactcagcctaatagaggaccctgagcaaagttaacctctttgagtttcagtttcctcatctctaaaatggggataattgtacctactcgaggattgttaaaaggattaaataaggtaatgtgggttgagcacaaaaatagagtgcttggcacacagtaggtgcacagtaaattctgacggtgggtcgtggtggtgggtggtggtggtagttgtagttgttgttattattaatattttgactcagtctctgcattctgcaaaatgacagttctctcggggtgaagatgattacaaagccatgtttcaacaggtggcatataccacgaggcagtaaggtatagtggtaagagattcagagaaacctgggttctggttcctgctctgtcacttgcaagcctttcagagcctcagtttcctcatctgtaaagtgaggataacatcaacctttcaggattttgttaggatcaaaagctaatatatgtagagcccctcgcacagtgcctggcagagtaagtactcaataaatgtgagccattgttattagtagactttaatagcaaagagagaagttggtgtgggatggtgaagtagcagaggcaccagaggagaattcctttaagctcagaagctgtaaagttttatttagtgcccaggatatatacatccatgctgaagggtggtcaaagtgagctgggaagttgtgcttctagcctcaatgcttgcagcatgtttcactgcctacaccatagcttacagtgtccacctcctacctctcattttcctccagtcccatctgtcaaaatcattcaggatagttaaaggcttaccttttctccagcgcctctcacttaaaccacaaaactttgggctggttggaagaggacttagagatagattatatgtggtccatgggctttcaaatgttttaaagcaatggaatcctttttttaaaatgacatcttaggtggaagcccaatattcaaagcataactgctttgaataagatgaaggtgggaggcccagggctccacttgttcttctcattcgccttctaccttcccccgattctcggggctcctcccaagaagctcaaaggagccacagaacatcttcaaaaatcacctttccagtctagtcctttaattttacagctaagcaaacagtctcaaatggtcagataactttcctgagctagttacagagctagctagcagcagaattaggactagaacctctccttctctcaaatcctgtagtccttagaatttgaaccacacagattagtacttgattattttctgtctcatgtcagctacttaatggagtattttctctccagttttgacagtagtgctttgctcgtcttcttacttgtcaatggctgggtaaagaaatgccacccaataaattcttgatgactcattatgtaaaagctagggtgtgcatatgtggagcatctataagccacttccatggcagtaccaccagtaccaggaacagacctctgctgttagtgttgagagaacccttgagtaagctctaaccccctcatgtactaacactcttgtaggacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaaggtgggtgctggcccatgggttcagcccaacccttttgggtgtcccttggaagagcagggtttcaaaaagcaggctatcctgtctggctgccatgtcccttagaccccctgctgtttggctaccagtcccactcatttaataggcatttattgagaccttttctatgccgggcactgtgataggtgctgtggatgtgactctcaagaggctgacaggcgagtgagaaagacaggcataaaaacaaatgagtgcaatcaagtattgtgaatgccacaatcaggggtgtgtgtgggaccctgagatacagaggagggttgattctgtctgggtagggaagattttcaggagctcttttcagaaaacataacacttagctgaattttgaaatgctgggacgggaatgagatttgaaaacattgcgtgtgtcaggttgtagtcttgagcaggtccttgagaaaagccctccaccagggctccatcttgcctcaagattgtgattctctccatgggcatctgaagatgtgccccctcttttttaagggaacatggttcacaagattgacaggtgtcccctgaaccaaccacacattttcaacctcctgctcctgtgatcagtgggggtatggggggacagtatagcagaaggccttggctcaggtggttttgacagtgaactgaaccagtgaaaccagagggaacttgccatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccactgagacagggcatggaattggaatctaggggttgggacatgggtaggagggactgtacttagggcaatacctagatattataatgtattgttgcttagttcagagaaccatggtgtggtgttggaggtgggtagagtgagaggtctgaaatcgaattggcaagcctgagaaagattttatcagttctagaaacttcagcaagtcattgggagagaaccactggcagcaataagtatagcatacttactaaaagcattagttttttctataccttttgactttcgattagatttttaggaatttagtttacagaaatccttgcacacaagtgtgtaacgataaatgttcagtgttcactgcaccattgtttgtaatagtaattggaaacatccaaatgttcatcagtaagggctagataaataaatgatggtacatctatagaatggaatatcatgtagctgttaaaaagaatgagacagttaaatattgacacagaaagatgttcaaggtatatttttaaaatcaggttacataataatacataggaatagttccatttttacttttaaaagggcatgtatgcacatgtgtatatgtatgcacgtatggaaaagctgtatatagacatttgtattttttgaagaggtttaaaaatgcaatatacaagcgttagaaataaaacagtgtgaaagagcacacagtgaaaaatctcacacccatctctctttccctgttaccttcccatggacaaccaatgtcagtggtttccttccagagatatgtatgtacatttaggcaaataaatagtgtgttatatatatgtaaatacctttaaaaaaaaatagagatggggtctctgttattgcccaggctgagctctaactcctagactcaggtgatcctctcacttcagcctccagagtgctgggattacaggtgtgagccaccttgcctggcctagttatatattttatacttctcataccaagttttgttttttttttttttttttttttttgagacagagtctcactctgttaccaggctggaatgcagtggtgcgatctcagctcactgcaacctctgccctgctcggttcaagtgattctcgtgtctcagcctcccaaatagctgggactgcaggcgcatgccactatgcccagctaatttttgtatttttagtagagacagggtttccgcatgttggccaggctggtctcgaactcctggcctcgagtgatccgcccacctcggtctcccaaagtgctgggattacaggcatgagccaacatgcccggccttgttataccaagtttttaacagtggttatccctggaaagtacaatagggaaggtaagagcaaattttcacttcagtagcatttgaattttgtacaatgagcacgtatttacttttctttaaatatttatttacttttctttaaataattttaaaagaacaagttctaaaagaataaaataaaagctgtttacaacaaaattatggacttgggaatcaggcagtccgaggtttaaatcccagctgtgacacatattcagtgttctactttggcaaactaatgaacctatctgagcttcagtgtcctcattatatgtattctatagttaaaacttaccttagggttgttggaggattaaatgagataatatacgtagaacgttaaccacagggcctgccatataattaatacttaatacatggtagttcttataaatatgatgatgaagatagagacaaaagaattctccatgaagatggtgataatgatgtgggtatgaccagaatccaagaagattgtcagaaaccctgaaatacatagaggcaggggaaggcagtaagggctattttctagatactcagaacactagacatcagcagtcaagagccaagtgcagagtatgaacgatgtaggaacacaaacaacaaaggtagcttaattgcctccttgtaggaaaaggttaccttcaggtccatctgggcccatctgggtggaaaataagggaaaaaggagtgagagtagggcagattctgaaagcaacagagctattcttggggtttgagaatccagttactaaagtgtaagattagagagaccgttgaatattgcctttgtccagaactcatgataggtctcctggacaggagaaaattcagagtcctaggagtctagcctataatggctattgaaggtacaataagacatttcctgcccctgccccacccccagcagtccttcttgtgctgctgcctattacccgctgcagctgtcagaagctgttaagtgaacccagatagtcaaagtatagaaatatttacagatgatgtgatgctatgtctgggcttctctccaaacttggtgttttgaagagaatgaggtgtagatgaaacaagactggctgggttgataattgctgaaacttagctgagtgataggtatatgagaattaattctacttttatatttttgtgtatttgaaatttttctttaaaatttttttaaaaattattagagacagggtcttgctgtattgcctgggctcaagcagttctcttgcctcagcctcttgagttagctgatactacagacatgcactaccacaacccagctgaaatttttaattattagaagttaataaaagatcagggcatacatagctgtcatttattgagcatctcctctgtgtcaaagtctatcttagctgtttatatacactattttatttaatcctcacaaccccaaaagtaagtagtagtatccccattttactaaggtgaaaactgagagtcagagaaccttataatattacctacatggagcagttgccatggatcaagctctgtatgagctcatttaatcctcaaccctctgaagtagaaaataggtcagttaaatgacagacaattcactgaaagtcaatttaaccaaattactagttgctaaatgtatcaatttactgatttaccaaaaacatgtttctttttaactgtttatgaggtttttttcagcagtttgtattggttaatatcgtctactatgtgtaacaggattatctaagccactttttgagtcctgaacaaaggcagtgttcatttcaaccagcaatcatgagtgtcttcacttactggccaacgtttgttgttttttttttctttttgactgtagccattgaggtttttccagcagtttatattggttaatatcatctactatgtgtaacaagattatctaagccacttttgagttctggacaaaggcaatgttcatttcaaccagcaatcatgagtttcttcacttactggccaacatttgttattttttttttcttcttgactatagccattccggtggatgtaaagtggtaactcattgtatgtgttttttaaaaaataaaaattgtggcccggtgcagtggctcacagctgtaatcccaacactttgggaggccagggtgggcggatcacttgttaggagtttgagaccagcctggccaacatgacgaaacccttgtctctactaaaatcataaaaattagccagacatggtggtgggtgcctgtaatcccagctacttgggaggctgagacaggagaattgcttgaacctaggaggcgggaggttttagtgagccaagatcatgccactgtactccagcctgggcgacagagcaagactccatctcaaaaagaaaaaaaaaaaaagcaaatataaaaattgtctatatttaaggtatacaatgtgatatttgataaaatctatactgtgaaatgattatgccagtaaagctgattaacatatgcatcacttcacatacttaccatttttgtgtgtgtttgtggtgagaacacataggtctactctcttatgaaatttcaagtatacaatacagtattttttttttttttttgagacggagtcttgctgaggcaagagaattacttgaacctgagaggcggaggttgccgtgagctgagatcatgccattgaactccagcctgggtgacagagcgagactctgtctcagaaaaaaaaaaaaaaaaatttttttttggatacaaatcctttgccagataaacgatttccaaatattttctcccagtctgtggcttatattttattttcttaatggtttcttttgaaatacaaaaatttttaattttacttaatcccaggtcataatgatatttttctgtgttttactctagttttatagttttaggttttacatttagatctatgatgcattttaagttaatttttgtatatgatgtgagataagggtccacatttatttctttgtatccatttttctcagcaacttctactgaaaaaaaccatcctttccctcactgagctgctttagcaccttttgtcaaaaatcatttgatcataactgtacgggtttattcggaactcttttccactgctgtatgtctgtctttatgctggtattgcattgccttgattaccatagctttagagtaaattttggaattgagcagtataagtcatccaatgttctttttcaaaattattttggctgtgttaggtcctttctatgtccatgtacgttttactatcagctttttatttaaaaagctggctggattttgatagggattgtattgaatctgtaggtcaatgtagagagaattgcaatcttgctagcgactaacaatactgctagtgactgtttttatgttctccttcccttcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaagtgtgtgtctgttctttctttttcctcccctgcccgtttttttgtttgtttgttttgagacggagttttgctcttgttgcccaggctggagtgcaatggcacgatcttggctcactgcaacctccgcctcccgggttcaagtgattctcctgcctcagcctcctgagtagctgggattacaggcatgtgccaccatgcctggctaattttgtatttttagtagagatgggatttcactatgttcatcaggctggtctcgaactcctgacctcaggtgatccgcccatctcagcctcccaaagtgctgggattacaggtgcaagccaccacgcccagcccttgcccattttatatttgtttttggccctcttgatagacttaagaccttaggcctgagcttgttgacattttgctatactatgttctgtaggccttcattgtttcctttgttctaaagatttatttatcacctgatccctaacctctaaattagtcatctgtggtcattacttccaagaaaattagtcttatttttttcttctgggtatttggctgaaatgctaatcatagcttcataataagtgcattccattgttttctagaatttccccggaaattgccccgtgcgaagccttgctctgaccccaaccgagttcgtgaaccaggagaagttgagtttgacattgaggtaggattctgccctggatctagtcttctgctcattctggtgatagagacagaagacagattgtcattctagttgggggatatgcagggaggaagacatcctttgcattcatttcctgaataatttatttattattactattattttttgagacagagtctcctcgctctgttgcccaggctggggtacaatggcatgatcatggttcacagcagtcttgacctccggggccagctcagccttctagtagctgggaccacaggctcacaccaccaatgtagctaattctttaaaaaaaatttttttttgtagagatagggtctcgctgtgttgcccaggctggtctcaaactcctgggctcaagcgatcttttgccttggcctcccaaagtgctggaatcacagggtgagccactgcatacagtgaaatatttattaagtgaaagattgtgtgccaagtgctgctgagcatataaatggaagatttcaatttagttgaaataccttaaacatcctttaatacagaatagaatgaaagtcagtgtgggccgggcgtggtggctcacgcctgtaatcccagcactttgggaggctgaggtgggcgtatcatgaggtcaagagatcaagaccatcctggccaatatggtgaaaccctgtctctgctaaaaaattagctgggcgtggtggcacacccctgtagtcccagctacttgggaggctgaggccgaagaatcgcttgaacccaggaggcagaggttgcagcgagccgagatcgtgccactgcactccagcctggcgacagaacgaggctctgtctgaaaacaaaaaataaaaagtcagtgcgatgtagcagaaagagtatgtgatatggagtatctgatgtgaccttacacaaattatttaacttccctgagccttagttttcttatctgtttaaaatgggagtatactacctagctcacaaagatgccttggaaattaagataaaagaatgaatattctgcttagtacttggtctatacttggtgctcagaagatattaatatcaggagtcagatcatcgcccctgtactggggccttaccagaccaatcctgggcagctgaggtgatacactctctctccaacaggaggactatacaacagatgaggacatggtggaaggggttgaaggcaagcttgggaatggtagtggcgctggtggcattcttgatctgctcaaggccagcaggcaggtggggggacctgactatgctgccctcacgtgagtactggcttttatctcccctttccaggctatcagacagcaacccccgctcccgcccaaggtgccaggtcagccaatcagtagatatttatagagctatttaaagggacaaagaattatccagggcatttgggtgaaagaataaagtaggcatgaaaccactcctaaggaacttaagatctgatggcaataagatgtatagacttcaagaggaatcaattttgggcacttaggaagttgggaagaggggctggaagagtcaagcaaggagaattgttacaaaaacaatgaaaggaaagaatgcagcatgcctaaacagggagggaagtgtgccccttttttgccaccttgcctgctgtctgtggagagacaacacaaaaaggactggcttttcgtgaaagcaatctatgatactgtcttgatccttaaacttaattccaaatttttcactttggatgattctcccctttttcctcccactttgatcctcatagctatcatccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatagtaagggcagctaagcacatgggttcaggccagaaggggtctcctcagtcccagtctccatcctagtcccaatagaggacagcttgtagtgaacaaagtcctggtcttaagcctgatacttagtttctctaagccatattttcctaatttgtaaaatgggaatatctcacaggttaatgttaagaatttgagattatgctcacacagatcatctggcacagtttcttgctcatgggaagccttcaaaaaatggtagttataatttgctatcatctatttttactaatgtccaacctttaccgctggtgactctttttttctcttgcctgtttgactgccatcatctgtgtcatttgtgtcctgcgttggccagtttgtcccttgcagagatacataatgacctttcagtgagctttttacatttaagagatgactcctttttttaatccaagattttattgagtaccacagtgtatcaggcactcttgtgtaatacaggtgactgtataatgtaagtgctttttgttttgttttgttttgttttttttgagacagaatctccctcattaacccagggtggagtgcagtggtgccatctcagctcactgccacctccgcctcctgggttcaagcaattctcgtgcctcagcctcccgagtagttgggattacaggcgtgtactatcacgcctggctaatttttgtatttttactagagacaaggttttgtcatgttggctagggtgatctcgaattcctggcctcaagtgatctgcccgcctgccttggcgtcccaaagtgctgggattataggcgtgagccatcgcgcccggccattgttttaatatttcaaaagttatacaaatatggttaatgcttattgaccaaaattagaagaagatggagaaagcaaaaattctttttgactaacactgtttcctctctgaacccaaagataacctttgtcatcattttcatgtataccttttattttgttgtgtttacattcatatgtagacagaagtgtagttttagtgtgtgtggttctgcaacttgcttagttttctttcaatgtcagtgcagagatataccttatcaatacagagatctatctgctgcatagtgttctgtaatatagaaatatatcatatgtttaatcattccctactgattgacatttaagttgttcctaagtttttacttttactaacaatgctgcaatgaaaattcttacagtaaccttttgtacctgtgtgccagttaatatttttctaggggggatagacctgttgagttgaagggtatgtagaagacaaatgttaataaatagtgccaaatttccctccaaaagggccagtacatgatcagtgtatgaaacatacctgtttacccatagtcttaccagcaatggatactatcagcctttttaatttttgccaaccttatggcaaaagatggtgtcttgtttgttttacgtgtttattgactcttctttattccttttctgtgaattttccattcagtctttcacccatttttctgttgggatgttttgtttttcttattgatttgtaagagttccttatatattctagatgtgttggagtattttttgtatattctggatttattgaaaaatatttccttttaggtttgtgtttaattttattatgtctttctagcatgtagatgattttgatttttacattgtcatctttatcaatttttttttttttttttgagacacagtctcactctgtctcccaggctggagtgcagtggcgcaatcatggctcactgcagcctcagacctctgcagtcccacctcaacctccctggtagctgggaccataggtgcataccaccacacccagcttattttttgtacagatggggtttcgccatgttgcccaggctggtctcaaactcctgggctcaagtggtcctcctgccttggtctcccaaagtgctgggattataggcgtgagccactgcatccagccatctttatcagtttttaatagttttttgtattttatgttttgattaagaaggccttcttatattttcccctaaaacttgtataggagttaaaattttagctctttatctggaattaagtttttgtgaattgtgggaggttagaatctaactttatttttttccacatcagtagtcatttcccccagcaccatttattgactaattcatcattatccccctgacttgaagttctacctttgtcataaacgaaattcccatatatatggggatttgttttccactttagtccaagttctgtaccttaatagctatatgaccttggtcaggctagttaacctctctatgcctctctgtgatagtcatacctacctcataggttgttatgagagttaaataaatatacagaaagcacttaaaacattgcccagcacatgataagtaagtactgtgtattagatattattaatattattctgttccataaaatcaacttgtcaaaacaaatttttattttaccaaacagatgctaaaaaagaaaatgaaaatcaacttgtctattcctgtgacaataccatgtaggttagttaccacagactttgtttctggtagagcaaatcccctctgcagaccttgctgtgaacctgaggagaccacagatgctcaccaaggctctcatctttgagctaagctttgatttgttttagggacatgccaggttcccctggccacccactctactgtgagcagtcaaatcacattgacctgcagctaagatgtctggacttgatttaaccgctcctcttagaacagctcactcagcctctcctccctccttcgcctccctactttgcccagcaaccatggaaaggcagcttaccaaggagagacctccctactttttcttatttttccagaatttcgaggctgctgttgagctttttctattccagatggattttagaatcagcttttcaaaggattgcatggtgtttgtggattaatttatggagacctatctttcatcagaggcatttcggctatactgggatttgcgcattcctgaatataacctcatgtcctgaaaatttgtgcactaaaaacaataaggcaggcaaaaagagattagggccacagccctcaaaatctatgtgactttgaagccaaaatacagactcaaataatagcagttctaagttagagcccaatggcatttgtacccggcattatagtcagtggcttctctatggccttaagctctggactcagacttcctctttccaaatctggattcttttgagggcatttggttaaatagataccagcttcatcaaatcaaaatctgatccagggcctagtccctatcaatcttttttggcaaaacaaacaaacaaaaaaaaaacagagggaaatgtctttgcaacttctttatctgctctgtcaggtagcctatcccatcagaactaaattttgtagaaaatagtcaccatttattttttctctggtaggcaaacttgtgtgatttttaatttttgtctgtatgtcttcttatgttgctaaggctttctctgtagttgtgaaaaagtctaccactgattggttgtaaacaactatggaaaattgtttttgaactggtacaacttctgaacagcattgaaatcattgttttgtctttttgttgttgtttgtttgtttgttttgagaccgagtctcactttgtcgcccagggtggaatgaagtggcgtgatctgggctcactgcaatctctgccttcctggttcaaacagttctcctgccttggcctcccaagtagctgggattacaggcacacgccaccacgcctggctaattttttgtgtttttagtagagacagggtttcaccacgttggccaggccggtcttgaactcctgacctcaagtgatccacccgcctcagcctcccagagtgctgggattacaggcgcgagccaccaggcccagccagacatctttctcttatttaccttttgggtatgagcagcagccatcttttgtttctgtcttcaaacatagtctgtctctatttattcaggtcttcttgtatgtatctcttctttggtttatttcttcttcagtttatttctagaaattttattttggttcgtaaaattggcatctttttatgtattacgttttctaattggctattgctaatacggaggacagtagttgattctttcccatatcaatcctgtattggactaccttattatactgttattagttctatttgttttcagtttattgtcttgagttgttgaggtagatgatctgtgtgtcctgtattagtttgatagggctatcataacaaaatatcacagactgggtggcttaaacaacagaaagttatttccttacacttttggcagctgaaagttgaagatcaaggtgctggcagagttggtttttcctgaggtctctctgcttggcttgcagatggccttcgtcttgctgcctcttcatgtggtcatacttctgtgcatatacgcccatgacgtctctctgtatgtcctaatcaccacctcttataagaccaccagtcagattggtttagggcctactctaatggtctcattttaacttaattatttcttaaaaggctctatctctaaatatagttacattctgaatactaggggtaggtcttcaccatatgaattttaggggacaccattcaacccataatatcctcctcctctccagtattcatacctctagcttccagttttattacagtgttgagtcatagtggtgatgggggcatccttgtgctgttttcagactttaaagggaatactgccagtctttctccactcaatatataggtctctgttagactactctcatagagttcaggggagtctctagctatttatttacttatttagacacagtctcgctctatcacccaggctggagtgtagtggcgcaattttggctcaccgtagcctccacctcctgggctcaagtgatccttctacctcagcctcccgagtagctgggactgcaggtgcacgccaccactcctggttaatttttgtgtttttagtggaaacagggttttgccatgttgtccaggctagctttactttaaaagatttttttttgttttaaaatcaagaatcaaattaggttttaccaaataattttggcatatttggacataaatacatagtttttctatgttaatttgttaatacagtgaatgacattaataaaattactaattttgaatcgatattttcttgagattagctgtacttgtacttggttgtggtgtttaacaatagttcatctagtttatttgattgctagtcttttcaaaaactagttttttggctttattgatcatctctagtgtttgatattttattctctttttaatttttctgtattcaacatcttgagttgaaagctctgttgatgtattttcaatctgctttttggtaaagcgttttttaaattttatttttattttatttatttatttttgagacagagtctcgctctgtcacccaggctggggtgcagtggtgcaatctcggctcactgcaacctccgcctccccggttcaagcgattcttctgcctcagcctcctaagtagctgggattacaggtgtacgccaccacgcctggctaattttgtgtatttttagttgagacaggacttcaacatattggccaggctggtctcaaactcctgacctcaggtgatccacccgcctcagcctcccaaagtgctgggattataggcgtgacccactgtgcctggcctgaaattttattttttaaattaacatgaagtaaaattgactctcttggtatacacatgtttatattcttccagccaccataatcaggatacagagccctttgatcactccctaacctcctttgtgttactaccccctttgtagtcatgccttccctctactcccgagcaaccactgatctgctctctgtcactgtggtttttgcctttgccagaatgtcatataaatggaattatgcagtatgtaatattttgagactggtatcttttgcttaccataatgccttttttttttttttttttgagatggagcctcgcactgtcgcctgggctggagggcaatggcgtgatcttggctcactgcaacctctgccttccggattcacgtgaatctcctgcctcagcctcctgagtagctgggattaaaggcgcacaccaccacacctagctaattttttgtatttttagtagagacggggtttcactatgttggccagactggtctcgatctcctgacctcgtgatccgcccgcctcagcctcccaaagtgctgggattacaggcataagccactgcacccggcccaccataatggctttaatattcattcatgttgttgcatatcaaaagcttgttcttttttattgctgagtaatattccattgtatggattatacccattgaaggtcatttcagttgtttccactttggggtgattacaaatagagctgctgtgaacattcaggtataggttcttgtgtgaatatgagttttcatttttctagggtaaatacctaggaatgggattcctgggcggtatgggcagtgggtgttttaactttacaggaaaccactggctgggtgtggtggctcgtgcctgtaatcccagcactttgggaggccaaggcgggcacatcacgaggtcaggagttcgagaccagcctggccaatatggtcaaaccctgtctctactaaaaatacaaaaaatttagccaggtgtggtggcatgtgcctgtagtcccagctactcaggaggctgaggcagaagaattgcttcaacctgggaggtggaggttgcagtgaaccgagattgcatcactgcactccagcctggggggacagagtgagactccatctcaaaaaaaaaaaaaaaaaggccgggcgcagtggctgacgcctgtaatcccagcactttgggaggccgaggtgggtggatcacgaggtcaggagattgagaccatcctggctaacacggtgaaaccccgtctctactaaaaatacaaaaaattagccgggcgtggtgtcgggcgcctgtagtcccagctactcaggaggctgaggcaggagaatggcgtgaacccaggagtcggagcttgcagtgagccgagatcgcaccactgcactccagcccgggcaacagagcgagactctgtctcagaaaaaaaaaaaaaagctactgaactgtttcccagaatggttgttttacatttccactagcaatatgtggaattccagttgctctacatactcatcagcacttggttttgtcaatatagttattttaatcatcctaataagtatgtagtgatatctcatttagtgattcatctaatggctaatgataataaacaactttctgtgtgtttgccattcatatatcctcttttttgaagtgtcattaaacagacattttgaatgcattgttaagatttcttgttaaggatttaactatgaatttttctttttgttttcttttctttgtttttttgagccagtcttgctctgtcacccaggctggagtgcagtggcacgatctcggctcactgcaacctctgcctcctgggttcaagtgattctcatgcctcagcctcctgagtagctgagactataggtgcgtgccaccattccccagctaattttttttttctagtagagatgaggtttcaccatgttggccaggctggtcttgaactcctgaccttaagtaatccacccaccttggcctcccaaagtgctgggattattggcatgagccaccacacccagcctggatttattttctttagtagatatagaattttcaggttatctgtttgattttaggtgagttatttatttattttttatttatttattttttaagactagccaagggcagtagtgaaaagaggggaaagagtttgggtgagtttttatagtttgtatctttcaaggaattggtccatttcatataacttacagaatttatgggcatagagttgtttgtagaattcccctattattctttaaatgtctatggggtctttagtgatatcccccttttcccttctcattcttgatattggtaaattgtttcttctcttttttttttcctttgccattcttgctggcactttgtcttttttttttttttaacttaaaaagtgtttttagggctacaggtgcatgccactggctgtttttttatttttatggagatgggggtctcactgtgttgcatagccttgtgtcaaactcctgacctcaagtgatcatctcttctggacctcccaaagtgctgagattacaagtgtgagccaggccttattgtgtcaatttaatggatcttttcaatatttttggtttcattttctatgttttgtcagttacattccactcttaatgtagttaagattgctgtagttttattttattctttttctaatttcagagatgatcgtttagattatttatttgagacctttttcgtttctttttttgctatttttattctattttattttattttatttttttgagacagagtcttggtctgtcacccaggctggagtgctgtggcgcagtctccgctcgctccaacctccacctcccaggttcaagtggttctcctgcctcagcctcccgagtagctgggattacagtcaggcgccaccatgtccagctaatttttgcatttttaatagaggtgggatttcaccaggctggtctcgagctcctgacctcaagtgatcgccctccttggcctcccgaagtactgggactaaaggtgtgagccaccatgcccagccttttttttttattttggtattttataaagttgatatattaacagcatattgtgtatattttggggttacatgtgatattttgatacatatatgcaatgtgtaatgatgaagttaggcttagtgatatatctatcatcaaacctttatttttgtgtcagaaacattataattctcttctagctgttttgaaatatgcagtaaattattaactgtaatttcttgactgtactattgaatgctagaatttattccttctatctaactgtatttttgtacccattaaccaactatttttcatcccccgcttcctttcccagcctctggtaaccaccattctactctccacctctgtgagatccacttttttagctctcacatatgagtgagaacatgcgatatttgtctgcgtattcctggcttatttcacttaatataatgacctccattttccttcattttactgcaagtgacaggatttcatttgttttaatggctaaataatattccattgtttatatataccacatttcttaattttactcatttgtccattgatggacacttaggttgattccatatcttggctattgtgaatagtattgcagtgaacatgggaatgcagatatctctttgatatactgatgtctttccttttggatatgcccagcagtcaaattgctggatcatatggtagttctatttttactttttcgagacacctccatactgttttctatgatagttgtactaccttatattcccaccaacagtagtatgaatgttcctctttctccaaatgctgaagagtaacaaatcctctccagcttttgttactttttgtcttttggataatagccattctaacttgaggtgagatgatttctcattgcagttttgatttctatttccctgatgatgagtgatattggacattttccccatatacctgttggacattttttttccaacttttaagttctggggtacatgtgcaggatgtgcaggtttgttacataggtaaacgtgtgccatggtggtttactgcacagaccaacctatcacctaggtattaagcccagcatccattagctgttcttccttgtactctccttccccaccactgacaggccctagtatatgttgttccccgcctcccatgtgtccatgtgttctcgtcattcagctcccacttacaagtgagaacatggggtatttagttttctgttcttgtgttagtttgctgagaataacagcttccagctccatccatgtccctgcagtggacgtgatgtcgttcctttttatgactgcatagtattccatgctgtatatgtaccagcttttctttatccagtctatcattgatgggcattttggttgattccatgtccttgctattgggaatactgctgcagtgaacatacgtgtgcacgtatctttataatagaattatttatattcctttgggtatatatccagtaataggattactgggtcaaatggtagttctgcctctagatctttgaggaatcaccatgctgtcttccacaatgcttgaactaatttacactctcaccaacagtgtaaaagcgttcctttttctctgcaacctcaccagcatctgttgttttttgagtttttaattgccatcctgctggtgtgagatagtgtctcattgtggttttgatttgcatttctctaatgaacagtgatgttgagctttttttcatatgatggccgcatgaatgtcttcttctttttttttttgagacggagtctcgctctgtcgcccaggctggagtgcagtggcacaatctcgactcactgcaagctccgcctcccgggttcatgccattcttctgcctcagcctcccgagtagctgggactgggactacaggcgcctgccaccacgcccagctaatttttttgtatttttagtagagactgggtttcaccatgttagccaggatggtctccatctcctgacctcgtgatccgcccgcctcagccccccaaagtgctgagattacaggtgtgagccaccgcgcccggctgaatgtcttctttttagtggggttgttttcttataaatttgtttaagttcctcttagactctggatattatacctttgccagatggatatattgcaaaaattttctcccattctgtaggttgtctgttcactctgattatagtttcttttgatgtgcagaagctctttaatttaattagatcccatttgtcaatttttacttttgttgcaattgcttttggcatttttgtcataaaatctttgcctgtgcctatgtcctgaatggtattgcctagattttcttctagggtttttatagtttggggttttacatttaggtccttcattcatcttgcgttaattcttgtatatggtataaggaagggatccagttttaattttctgcatatggctacctggttctccccagcaccacttattaaatagagaatcctttctctattgcttgtttttgtcaggtttgtcgaagattagatgtgtgtaggtgtgtggtctaacttctgggttctctattctgttcattggtctatgtgtctgtctttgtaccagttgcatgctgttttggttactgtagccttgtggtatgaagtcgggtagcgtgatgcctccagctttaattctttttgcttcggattgtcctggctatttgggctcttttttcattcaatgtgaattttcaagtagtttcttctaattctgtgaagaatgtcaatagtggtttaatgggaatagcattgaatctgtaaattactttgggcagcatggccattttcacgatattgattctttctgtccaggagcatggaatatttttccacttgttggtgtcctctctcatttccttgagcagtggtttgtagttctcctcgaagaggtccttcgtttcccttgttatgtgtattcataggtattacattctttctgtagcaattgtgaatgggagttcattcatgatatggctctctgcttgtctgttgttggtgtaaagaaatgcttgtgatttttgcacattgattttgtatcctgagactttgctgaagttgcttatcagctgaagaagcttttgggctgaggtgatggggttttctatatataggatcatgtcatctgaaaacaaagataatgttacttcctctctccctgtttgaataccctttatttctttctcttgcctggttgccatggccagaacttccaatgctatgttgaataggagtggcgagagagggcattcttgtcttgtgccagttttcaaggggaatgcttccatcttttgcccatttagtatgatactggctgtgggtttttcatatatggctcttattattttgaggtatgttccttcagtacctagataattgagagtttttaacatgaagggatgttgaattttatcaaaggtattttctgcatctattgagataatcatgtttttgactttagttctgtttatgtgatgaattacgtttattgatttgcatatgttgaaccaactttgcatcccagggatgaagccaacctgatggtggcggataagcttttagatgtgctgctggattcagtttgctcatattttattgaggatttttgcatcagtgttcatcagggatgttggcttgaagttttctttttctttttttttttttttttttttttgagacagcgtcttgccctgtcaccaggctgaagtgcagtgacgtgatctctgctcactgcaacctctgcctcctgggttcaagtgattctcctgcctcagcctctcgagtagctggaactacagatgcgtaccactatgcccagctaatttttctatttttagtagagacggggtttcaccatgttggccaggatggtcttgatctcttgacctcgtggtctgcctgcctcggcctcccaaagtgctgggattacaggcgtgagccaccgcagccggccgaagttttctttttttgttgtatctctgccaggttttggtatcaggatgatgctggcctcataaaatgagttagggaggagtcccttcttttcaattttttggaatagtttcagtagaaatggtaccagctcttctttgtacctgtagtggaattcagctataaatctctctggtcctgggctttttttggttggtaggctatttattactgcctcaatttctgaactcattattggtctattcagggattcagttccttcctagttcattcttcggagggtgtatgtgtccaagaattcatccatttcttccagattttctagtttatgtgcatagaggtatttatagtattctctgatggttgtttgtatttctgtggagtcagtggtgatatctcccttatcatttctggttgtgtctgtttgattttctctcttttgttcttcattagtctagctaatggtctatctattttattaattttttcaaaaaagaagctcctgaatttgttgattttttgtttttttgaagggtttttcgtgtctctgtctccttccgttcagctctgatcttggttatttcttgtcttctgctagctttgggatttgtttgctcttggttctctagttcttttagttgtgaattttgagatctttctagcttcttgatgtgggcatttagtgctataaatttccttcttaacactggtttagctgcatcccagagattctcatacattgtctctttgttctcattagtttcaaagaacttcttgatttctgccttaatttcattatttacccaggagtcattcaggagcaggttgttcagtttccatgtagttgtgtggttttgagtgaatttcttagttttgagttctaattttattgtgctgtggtctgagagactgttatgatttcagttcttttgcatttgctgaggagtgttttacctccgattatgtgatcaattttaaagtgccatgtggtgatgagaagaatgtatattttgttttttgggtggagggttctgtagatatctatcaggtccacttgatccagagctgagttcaggttctgaatatctttgttaattttctgtctagatggtctgtctaatatcgtcagtggggtattaaagtctcccactatttttgtgtgggagtctacgtttctttgtaggtctctacgaacttgctttacgaatctgggtgctcctatattgggtacatatatatttaggatagttaggtcttcttgtggaattgaaccctttatcattatgtaatgcccttctttgtcatttttgatctttgttgatttaaagtctgttttgtcagaaactaggattgtgacccctgctgttttctgtttttcatttgcttggtaaatttccctccatcccttcgttttgagcttatgtgtgtctgcacttaagatgggtctcctgaagacagcatactgatgggtcttgactctatccagcttgccattctatgtcttttaattggggcatatttagcccatttacatttaaggttaatattgttacgtgtgaatttaatcctgtcatcatgatggtagctggttattttgtagacttgtttatatggttgcttcatagtgtcactggtctgtatacttcagtgtgtttttactaaagtacttcctttaggagctcctgttggccatttctatgtctttttttgagaaatgtctgttctggtattttgcccatttttaaattggattatttgttttttgctattgagttccttatatattttagttattaatcctaatcccttgtcagatggatagtttgcagatattttctcccattctgtgggttgtctctgcactttgttgattgtttcctttgctgtacagaagctttttggcttaatgtaattatatttgtgtattcttgcatttgttgcctgtgcttttgagttcttactccaaaacaatctttgcccagaccaatgtcctatagcatttccccagtattttcttgtagtagtttcatagtttcaggtcttacatttaagtcttttaatccattttcaattgatttttttgtatatggcaagagataaaggtctagtttcattcttttgcatatgggtattcggttttcctgacaccatttattaaagagactgttctttccccagtgaatgttcttggtgccttcgtggaaagtgagtgggctataagtgggtggatttatttctggattctctatgctgttctgttggcccatgtatctgttttaatgccagtaccatgctgttttggttactgtagctttgtaatataatttgaaatcaggtagtatgaggcttccagctttgttcttactgctcagtattgctttagttatttggcatcttttgcagttttatgtgaattttaggattgctttttctatttctgtgaagaatgtcattggtattttgttagggattgcatggaatctatagatcgtttttgggtagtatagacattttagcaatattagttcttccaatacatgtgcatatgctatctttccattttttgtgtgtccccttcaatttttttcatcagtgttttgtagttttccttgtagagatcttgcaattatttggttaaatttattcccaggtattttaagttttttgtagctattgtaaaggggattgctttttttagttttttttttagatcattcactgttagcacatgtaaatgctactgatttttgtatgttgattttgtatcctgcaactttactgaggtgttttttttgttgttgttgtttttgagacagagtctcgttctgtcacccaggctggagttcagtggcatgatctcagctcactgcaacctttgtcccccggattcaagtggtcctttcacctcagccacccaagtagctgggactacaggtgcccaccaccacacccagctaatttttgcatttttagtagagatgagggtttaccatgttgcccaggttggtctcaaactcctgagctcaagctatctgcccgtctcagcctcccaaagtgctgggattacaggcatgagccactgcacccagccatctttactaaatttgtttatcagttcttttatttttattttttgagatggagtcttgctctgtcacctaggctggagtgcagtggcgcaatcttggctcactgcaacctccgcctcctgggttcaagcgattctcctgcctcagcctccaagtaaccgggattacagatgcccgccatcacgcccagctaattttttgtatttttagtagagatggggtttcaccatattggccagactgatctcgaactcctgacctcaggtgatctgcccaccttggccttccaaagtgctgggattacaggcgtgagccaccgtgcccggcgaggcctgtagttttaattgttgtatttttttctggttttggtatcaggataatgctggcctcatagaatgagttttgtggaagtattccctcctcttcagttttttgagttaaggtagaattgttgttttaatgtttggtagaattcagcagtgaatccatcaggttctgggcatttatttgatgggagacttcttattactgcttcagtctcattacttcttgtctgttcaggttttctgtttcttcatggttcaagcatggtaggttatatgtgtccaagaatttatccatttcttcccagtttccaatttgttggtgtatagttgttcatagtagtctctacctttgtatttctgtgatatcagttgtaatgattcctttctcatgagatatttttaatttctaatgtaaacatttagtactttaaattttcctctaagcagagctttctttgcgtcccccaagttttatgttgcaatttcactttttttttttttttaatttttatttttattgatcattcttgggtgtttctcacagagagggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttccacacagacatggcaaccatccgatttctcaatcttttccccacctttccccgctttctattccacaaaaccaccattgtcatcatggcccgttctcaatgagctgttgggcacacctcccagatggggtggtggccgggcagaggggctcctcacttcccagtaggggcggccgggcagaggcgcccctcacctcccggacggggcggctggctgggcggagggctgacccccccacctccctcccggatgaggtggctggccgggcagaggggctcctcacttcccagtaggggcagccgggcagaggcgcccctcacctcccggacggggcggctggccgggcggggggctgaccccccacctccctcccggacggggcggctggccgggcggggggctgacccccccacctccctcccggacggggcggctggccgggcagggggctgacccccccacctccctcccggacggggcggctggccgggcagaggggctcctcacttcccagtaggggcggccgggcagaggcgcccctcacctcccggacggggcggctggccgggcggggggctgaccccccacctccctcccggatggggcagctgccaggcagagacgctcctcacttcccagacggggtggctgccgggcggaggggctcctcacttctcagacggggcagctgccgggcggagggtctcctcacttctcagatggggcggttgccaggcggagggtctcctcccttcccagatggggcggctgggcagagacgctcctcacctcccagacggggtcgcgaccgggcagaggcgctcctcacatcccagacggggcggcggggcaaaggcactccccacatctcagacgatgggcggccgggcagagacgctcctcacttcctagatgggatggcggccgggaagaggcgctcctcacttcctagatgggatggcagccgggcagagacgctcctcactttccagactgggcagccaggcagaggggctcctcacatcccagacgatgggtggccaggcagagacgctcctcacttcctagacggagtggcggccgggcagtggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggccgaggctggcggatcactcgcggttaggagctggaggccagcccggccaacacagcgaaacccagtctccaccaaaaaaatacgaaaaccagtcaggcgtggcggcacgcgcctgcagtcgcaggcactcggcaggctgaggcaggagaatcaggcagggaggttgcagtgagccgagatggcagcagtacagtccagcttcagctcggcatcagagggagaccgtggaaagagagggagagggagaccgtggggagagggagaggagggagagggagagggagagggacaatttcacttttattaatggaaatattttctgttttcctgtgggatctcctctttgacccatgtttatttaaaagtatgtttaatttttatgtgttagaggtattccagttatctttctattgctgctttttgttctttttgttaagacatcattcttctggtttccttttgttctttgtcagtggtttccttttgctctttcagcctagttgatttagtctttgtatggtaaatacaatgtcagagcttccttagggacagtttttgtcagtttctctttttttttcccccgtaaatgggccatacttcccttttcgttgcatgcctcatggttttttttgttggaaactggaaattttgaatattataatgtggtttactctggaagtcaaattttccttcctcagtttgcttttgttgcttgttatgaactgcagtcatctattatttagtgacttttcccaactactttttacaaagattgtattccttattgtgcagttactgagtctccattccttagcctcattagtaagctgagactttctgatagagatttcctgacaactttgtttgtttggaaggcaggagtacagtggcacaatcttggctcactgcagcctccacctcccgggttcaagcaagtctcgtgcctcagcctcccgagtagctaggattacaggcatgtgctaccacgcgtggctaatttttgtatttttagtagagacagggttttgccatgttggcgaggctggtcttgaactcctgacctcaagtgatccgcctgcatctggagtttcttaaagacatgatttagcagcctttttctttgttaatcaccccttgttgttgtgagatttttattggactccagagttccataaaagttgttctgacagtttttgccaggttgatggttgtttcagtggagggacagatcattttagctccctattactccattatcagtggtgtcactcctccttccctgcaccctcttcgtgtgtgtgtgcgtgcgtgtgtgtgtgtgcacacgtgcacgtgcatgttctttttttttggtaaaaaacacataccattaaatttatcatcttttttccattatttacctttaagctccgttagacttgacaaatttaccatcttaatcattttaaagtgtatagttcagtactattaagtatattcacattgttgtgcaacagatctctataactttttcatcttgcaacacttaaactgtatacccctaaacactaattcctccctctagccattggtcatcaccttctactttctttcttttcttttttttttttttttttttgaggcagagtttttgctcttgttgcccaggctggagtgcagtggcacgatcttggctcactgcaacctccgcctccaaggttcaagtgattctcctgcgtcagcctcctgagtagctgggattacaggtgcgcgccaccacgcccagctacttttttgtatttttaatagagacagagtttcgttatgttggccaggctggtctcgaactcatgacctcaggtgatccacctgcctcagcctcccagagtgcagggattacaggcatgagccactgcgcccgacctctactttctatttctatgattttgacacctttaggtactttgtaagagtggaattgtatagcatttgttctggcctttttttcttagcataatatcttccatgttcatccatgttgtagtatgtgatagctttcctttttttaaggctgcataataactgctgtgtgtacctaccatactttcttttatttttcctttttttaaattatacgtttctgggatacatgtgcagaacgtgcaggtttgttacataggtatacatgtgccatagtggtttgctgcacccatcaacccgtcatctacattaggtatttctcctaaagctatccctcccctagcccccttccccctcacaggccccagtgtgtgatgtttccctccctgttttcatgtgttctcattgttcaactctcacttatgaatgagaatatgcggtgtttggttttctgtcctgtgttagtttgctgagaatgatggtttccaacttcatccatgtccctgcaaaggacacgaactcatcctttttatggctgcaaagtattccatggtatatgtgtgccacattttctctatccagtctatcagtgatgggcatttgggttggttccaagtctttgctattgtgtacagtgctgcaataaacatacgtgtgcatgtgtctttctagtagaatgatttataatcctctgggtatatacccagtaatgggattgctgggtcaaatggtatttctcgttctagatccctgaggaatcgccacactgtcttccacagtggttgaactaatttacactcccaccaacagtgtaaaagcattcctatttctccacatcctctccagcatctgttgtttcctgactttttaatgatcaccattctaactggcttgagatggtatctcattgtggtttcgatttgcatttctctaatgaccagtgatgatgagtattttttcatatgtttgttggctggataaatgtcttcttttgagaagtgtctgttcatatccttcacccactttttgatgggattgtttgtttttttcagcccaggtgatctttttgttccctttgtgtgcattaagtatgtactgtttatttcttcattcacttagtaaacagttactgagaacttgtgcttcagtgtgctagtaggctcccttaatttgaaataaataatacatattcctgcccttatggtaaattggaggcaacagatttgctaatcagctcttaaataccatataacagcttcagtagagggatgcacaggaagctatggagagccaagtaggaggcatctcaatcatgattaggagagggagggaagagttcttgtggaaagtaaatctaaagctgaattttgaagggtgagtaagtaaagtaactcatgaagttattcactaaatggatgttgggtgaatgaatcagaattaggtgaatctaggagaaggacatttgctgcaaggatgcaaagtagaagggcatgaaatgtatgtggtacattcagagactcttggagttgagtatggattaagtaaaaggtacatttgtaggggaagggcaggagctggagtaggtgtcattctatcttcaccctttggatgaaatctcattttaccctgttttcccttctccctgcagtctatccttcactggagtctgatgatgatgaccctgctttgaaatctcgacccaagaaaaagaagaattcagatgatgctccatggagtcctaaaggtaatctagtattttgtcccttaaactctgtaggggtggtcaggaggaaatagacaaggtaggtgggatatttaatatcagaagacctgattcagtcactcatttgtttattcagcaaacatttgttgagtgtctgctgtgtgtcaggcactgtgttaggttctggagctaaaatgactaataagacacagagtttatgtaattagtccaataaaatcagaggtaatggagcatattgcatttgatattatatggtttgaggtgaaaggaagaccttgaacagattttagcaagcagtctgaggcttctgagaacgttctgataccatcatcccagtactctggtagttttgttgtcaaggagggaaattctgctgactgttgagctctataaggcccaagattatcacctatactgagaggccatctctgaggagggaagaatgaccactgagttgaacatggagtttagaggataatggaagaattttcttcgtctccttggctggatagtattcacactgaggatgcatccttcagttagtttttgctgcttaacagtctgcccaaaacttagtggcttaaaataacagttaataatttttcataattctgtaggttggctgagctgttcttctagtctaggccagattccctggggctgaatggtctcaaaagttctccttcaggtgtctcagacctactatctaagtcctactaagacctactatctaagatggccaaggcttctctctacatggtctttagtctaccaagcttttccacaaggtggcagaaaggtttctagcagcaagagaggacaagccccaatgtgcaagcacttttcaagcctttgcttaagtcatatttactgttgtcccattgactaaaacaagttacgtggccaagccttgatcccatggttgggaaatagattgcaccttttgagaggagaactgcaaagtcacatcgcaaagtatcatgcatacgaggatacatgagcacactgaaggccattactgcaacagtctgccatagaggtcattgggatttcagtacctgtggttccccagcagataaagggcttgctcttctcaccctgccttatttagactttttggtgtttgcttgaggtcgagggggtgacataggggtagcagggcattcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggaaaaaaaaaaaaatttggctaggtgcagtgtggctcatgcctttaatcccaacattttgggaggctgaggcgggtggatcacttgaggtcaggagtttgagaccagcctggccaacatggtaaaaccccatctctactaaaaatacaaaaatcagctgcatgtggtggcatgtgcgtttagtcccagctactcgagaggctgaggcacgagaattgcttgaacctcggaaagcggaggttgcactgagccgagaccatgccactgcactccagcctgggcaacagagcgagactccatctcaaaaaaaaaaagaaaacttaggcctatttttaaattttattttcttctatcatttccaggtttatttttcctgtcaaagtaaatttttctggttagcacagtagaaaatttagaaaatattgaaaataaagggaattatgaagaaggaaccacccacgagtccgccacccagaagcaaccaatgttaacattttgacatgtttctttatagtcttttccctatacattttttaatttttattgtttaaatcacatgtgtgtacaattttttaaatttttttttaaattttttttaaatggagtctagctctgtcccaggctagagtgcagtggcgggatcttggctcactgcaatctccgcctcccgggttcaagctattctcttgcctcagcctcccaagtagctgggattacaggcaggtgccaccatgcctgactaattttttgtatttttagtagagatggggtttcaccatgttggccaggctggtcttgaactcctgacctcatgatctgcccgcttcagcctcccaaagtgctggaattacaggtatgagccaccacgcctggccacatgtatacaattatgcactgtactttaaaattttgtttgagcttttgatcaaagtagtgggtgtagcatatcaaaaagtatagagaaattaggccaggtgcggtggctcacgcctgtaatcccagcactttgggaggccgaggcgggtggatcacaaggtcaggagatcgagaccatcctggctaacacggtgaaaccccgtctctactaaagatacaaaaacttagccgggcgtggtggcaggcgcctgtagtcccagctactcgggaggctgaggcaggagaatggcatgaacctgagaggtggagcttgcagtgagccgagatcgcgccactacactccagcctgggtgacagagcgagactctgtctctcacacacacacaaaaaagtatagaaaaatttaggaggaaaagcaatgttcttctgcccctactttccccacctgcaatcccgttcccaagagacaacctcatagttttcgtttcctggtagatgcctccaaaactcaagagaagtatgccaccctttcttggtttatgaagtctatttctcctttaatcaacttacatcattcccttttttttttttttttttttttttgaggcagaaactcgctctgtggcccaggctggagtgcagtggtgcaatcttggctcactgcaacctccgcctcctggattcaaacgattctcatacctcagcctccaaagtagctgggactataggcgcgcatcactgcacccagctaatttttttgtatttttagtagagatggggttttgccatgttagctaggctggtctcgaactcctgacctcaagtgatccatctgcctcggcctcccagagtgctgtgattacaggccgtcaatctctcttgattacctactttgtaagatacagttgttggtgaccctacatccatagggtccttttgtaaccttctgtgaaccattttttcccttgtgggaagtaaatctaaagctgaattttgaagggtgagttagtaaagtaactcatgaagttattcaccacactaaatggatgttgtgtgaatgaatcagaattaggtgaatctagaaggacatttgccgcaaggatgcaaagtagaagggcatgaaattgtatgtggtacattcagagactcttggagttgagtatggattaagtaaaaggtacatttataggggaggggtacattcccttttgtaaccttctgtgaaccataattttttgtttatgctgtcaagtttattaacatatacattgttgttactactctacattgactagaaattaactgtaaatatcgaaaaccaatagagacatctggtcttttaagttaatattatatcataagcatgttcctatgccattgtttataaataatatttttaatggctacaagatatcagttccatggatatacctaatatatatgtaatttctaacatataggctattttcaagtttttacaattagtacatttggagtcaatatctttatatgtaaatgtttatatctctgattatttactcaggatggatcaccatgaaaccttagaggggccaaagtatgtgaggttatacaatgaaaagtttccttcccagccctgttagtagccttctacttacccacctggagtcaactagtgttatcagcttttttttttttttttttttttttttgagagggagtcttgctctgtcgcccaggctggagtgcagtggcgcgatctctgctcactgcaagctccgcctcctgggttcacgccattctcctgcctcagcctcccgagtagctgggactacaggcacccgccaccatgctaattttttgtacttttagtagagatggggtttcaccgtgttagccaggatggtctcgatctcctgacctcgtgatccgcccgcctcggcctcccaaagtgctgggattacaggcatgagccactacgcccggccatcagttttttcatttatcttctcagagacagtttgcacatatacaagcaaatgcatgtatatgttttcctacctccccctccttttttttttaactcagttggaaacgtattttatacgctgttatgtgctttgcttttctctcttaagaatacatctgggccaggcacggtggctcacgcctgtaatcccaacactttgggaggccagggtgagcggatcacgaggtcaggagatccagaccatcctggccaacatgatgaaaccccgtctctactaaaaatacaaaaattagctgggcatggtggcgcacgcctgtagtcccatctactcaggaggctgaggcaggagaatcgcttgaacccgggaggtggcggttgcagtgagccgagattttgccactgcactccagcctgggcgacagagcaagacttcatctcaaaaaaaaaaaaaaaatagttcttgatacttattgcagaagtgttttccagaaaagttgtaccaatttacacttccatccgcagtgcttgtttatgaaatgtatgcaggcattgaacacaccagttaggagtagtatttgattatgagtaatgtctcaagcatccttagtgagtgcttgttctctcagagtcacaagatggctacttcacctccagcattggggtctgggctgcagtcaggaagaaggagaaaagcaaaaggaaaaagggacaggcatgctgagtgctgagcattccctctccccaaggagttttaagttccacgttttttacacatctatttggctgaaattgtgtcagatggccaagactatcagccagagatgctaggagatacagtttttatctaggcatattgctgtcccacaaaatcagtgtttttgttagtaagcaggaaagagaatgacatttggttgagaatgagtagtctctaccatgagggtttttttgtttgtttgtttgtttgttttttatttattttgaaacagtctcggtctgtcgcccaggctggagtgcaatggcatgatcttggctcactgcaacctctgcctcccgggttcaagcaattctcctgcctcagcctcccaagtagctgggattacaggcacctgccaccacactcagctaattttttttgttgtttgttttttgagacagagtcgttctgtcaccagactggagtgcagtggcgagatcccggcccactgcaacctccgcctcctgggttaaagcaattctgcttcagcctcctgagtagctgggactacaggcacgcaccaccgcacccagctaattttttttttttttttgtatttttagtagagacggcatttcaccatgttggccaagatggtctcgatcccttgtccttgtgatccgcccatgtcagcctcccaaagtgctgggattacaggcatgagccaccgcgcctggccagttttttgtatttttagtagagacagggtttcgccatgttggccaggttggtctcgaactcctgacctcaggtgatccacctcggcctcccaaaatgttgggattacaggtgtgagccaccacatccggcttctaccatgaatttttgatccttggtaattcataagcaaacaacagtatctcattgatttaatttacatttttttgattaagcatagcctctatgttttattagcatcagagtttcttccattgtaaattttgtttacatcctttgcccacttatccatgtggttcttcaaggttttcgagttgcccattttatatagtaagggaatagtcatcctttgtttcatacacacacacacacacacacacacacacacacgcacatattttatacttataatgtgcttgtacttcttcctcattctacaggaaaatttgaatatttcagtatcaagtgttgatcatttgtttgcatattcagagagtagataattaacacccttgtattttttaagcataatttttaaatatctaatgtgttgatctacaaagaattgcttaatatatggtactgagcagaagatataaattggtattccccccaaaaagatgactgttggtgctagaatcacattcccactaagctgaaaatgctttctttgccatgtgtactgactcatacgtatcatgggttgtttgaggcacatccattttgtaccatcaaagttctgtctgctcttgtgctggtatttcacttattcactacctatttatgacttagaaaaaccacagacttttttattttgaggcagagtctcactctgttgcccaggctggagtgtagtagcatgatctctgctcactacaacctccgcctcccaggttcaagcgattctgctgcctcagcctcccaagaagctgggattaaaagcacccgccaccaccatgcctggctaatttttgtatttttagtagagatgggattttaccatgttggctaggctggtctcaaactcctgacctcaagtgattagcccgcctcagcctcccaaagtgctgagaattacaggtgtgagctaccacgcccagccaaaaaactgcaaacttttaaaaagtggcttttagttaactaaaaagatagttctttaaaatgaagaagaacaccaagtttaacccaataggatgaaactgtagagcacagatgcatcaactggtgttcatggacctttgaatctcctattaatattctattgaaattttatgtaaatgcatgcatctatgtatgtatatttctttagtaatttttatcacattttcaaagtgagttcttaactcaaaagatgcattctactaaggcattctactaaggggattcccattaagatcaggaataagactaatgtgcccactaacactgctattatttagtattgttctagaagttcatgccagtgtaattagaagtaaagcagaaattaaaaaaaaaaaaaaaaaaaagaaaagaagagaccaaatcatgatgtgagccagtagggtgagaatcctgttcacttttggccatcattgtatctgtagcactttgcctagtgcctggcctgtaggagatgtttaacaaatatttgatgagtgaaagataagatataattgtataatcgatatagaaaacacaggtatggggctgagcatggtggttaatgcctgtaatcctagcactttggaaaggtaagatgggaggattgtttgagcctaggagttcaagaccagcctgggccacatagtaagaccctgtctctacaaaaaatagaaataaaaatagagatatgatataattatgtaatatcagaaaatgaaagagaatcaactaaaaactgctaatactgataagagaattcagtaaattgggtaaatcattggatatataccagctatccaaaaatcaagaagtactatattagtaataaccataatgtactgagaaaaagaaatgctattgacaatagcaacaaacatataaaatatgcaagaataattgtaagaagatagtgtggaaccgacatgaagaaatagagatttcccatatgcctggttataaagactgagtgttgtaaagagtcatttccttccaaattaatgtatacatttaacactagcctaaatcaaaatcctaatggaattttgtggggaattcattctaaaagtaatttaaaaagtaaacaggtataattagcttaaagaatattgggatagagaaagtaaatgaaatatactatagtgctacagtaatcataagcaccagaacagtcggtaaatacttttccttttaaaaaatttttgttatgaaagttttcaaacataagataaaattcaagaggttattaccatgaacacctatatatatatatatatatatatctgtcacccagatttaatgaacattttgctgtatttgctttattctttttttcaaggcattttaagcaaaatcttacgtgttacgacatctctagttttttgctgattttttcttttctttttttttttttttttttttttttgagacagagtcttgctctgtcacccaggctggagtgcagtggcatgatcttggctcactgcaagctccgcctcctgggttcacgtcattctcctgcctcagcctccccagtagctgggactacaggcacctgccaccacacccagctaattttttgtattttttagtagagatggggtttcaccatgttagccaggattgtctcgatctcctgaccttgtgatccgcctaccttggcctcccaaagtgctgggattacaggcgtgagccaccacacctgtccgttttttgctgattttctaattgctctatccattattgaaaatgtggtattgaagtctccagctattattattgaatttatctattttctcccatcagtttggtcagttttcacttcatctattttgagcctctgttgtaaggtacacatatgtttgtaattgttataccttgttgatggattgacctttttatcattataaaatgctcttctttgtctttagtaatgatttttgtctcaaagtctgatgttagtatagccattgtagttttcatttgagtaccacttttattgttatctcttttttcatccatttattttcgacctgtgtcttcaaatctaaactgtgtgtcttgtatagatagcatatagtagggtcatttttaattcattctgccaacatctgcctatcagttggagggttctaatagctgccaaagttcgactcaatatccattttgctatttgttttctatgtgtcttattttttgttcctcaattcctccattagttactgccttcttttatgtttaatagctattttctaggaccccccccgcttttttttttttttgagacagagtgtcactctgtcacccaggctgaaatgcagcaacgcgatcttggctcactgcaatctctgcctcctgggttcaagcaattcttttcctgcctcagcctcctgagtagctgggattacaggtgcctgccatcacgcctagctaatttttatatttttagtagagttggggtttcaccgtgttggccaggctggtctcgaactcctgtcctcaggtgatccacccatcttggcctcccaaagtgctggaattacaggcatgagccaccgtgcccagccctaggatcccattttaattccttttttttttatctctctatatgtgaggggtttttttttgttgttgttttgtttttttttttttgagatggagtcttactctgttgcctaggctggagtgcagtggcacaatcgcgactcactgcaacctccacctcccgggttcaagcaatactcccgcctcagcctcctaagtagctgggaatacaggcacacaccaccaagcctgggtgatttttgtgtgtttagtggagacggggtttcaccatgttggccaaactggtctcaaactcctgacctcaggtgatcggccgcctcagcctcccaaagtgctgagattacaggcgcgagccaccgcacctggccaagttattttcttagtggttgtcctggggattaacaacttaatttataccattctaattcacattattatcacttaatttctttctttcttttttttttttttttgaggcagagtctcgctgtgtcgcccagattggagtgcagtggcaccatctcggctcggctcactgcaagctctgcctcccgggttcacgccattctcctgtctcagcctcccgagtagttgggactacaggcgcctgccaccacacccggctaattttctgtatttttagtagagacgaggtttcaccgtgttagccaggatggtgtccatctcctgacctcatgatccgcccgcctcagcctcccaaagtgctgggattacaggcgtgagccaccgcgcccagcctattatcacttaatttcagtactacacagaaactttgctgctatatagctccattacccttctcttttatgctattactgtcacaaattacatctttatacattgtgttcatgaacacagggttatagtaattgctttatgtaattgtctgttaatccagttagaaaaagttacaaaaatatgttgataatgtcttttaaatatacctatctagttacctttaccagtgctctttatttcttcatgtagactcaattgtctagtgtcctttcatttcagcctgaaggtttccctttaacatgccttttttttttttttgagacagagtctcgcactgtcgcctgggctggagtgcaatggcatgatttcagctcattataacctctgcctcccgggttcaagcaattctcctgcctcagcctaccaagtagctgggattacaggtgcctgccaccacgcctggctaattttttgtatttttagtagagacgggtttcactatgttggccaggctggtctcgaactcttgacctcgtaatctgcccgcttcggcctcccaaagtgctgggattacaggcatgagccaccacacctggccctttagcatttcttataggtaaggtctactagtgtcaaactatttgtttttatttatctaggaatatcttgatttcttcatttttgaaggatagttttgctggatctggaattcctgattgatagtttttcttttagcacttagaatatgtcttcgcactgtcttctaacctccatgggttctgatgataaagaaatcactttatgttgtgagtcacttctgccttgctgctttcaaaattctgttgtcgttggccgggcacagtggctcaagcctataatcccagcactttgggaggccgaggcgggcggatcacgaggtcaggagatcaagaccatcctggctaacacgatgaaaccctgtctctactaaaaatagaaaaaaaattagccgggcgtggtggcgggcacctgtagtcccagctactcaggaggctgaggcaggagaatggcgttaaccctggcggcagagcttgcaatgagccgagattgcaccactgcactccagcctgggtaatggagcaagactccgtctaaaaaaaaaaaaatttctgttgtctttggtttgagttatgatgtgtagccttttaaatttgttcagcttggagttcgttgagctcttgaatgtataaattgtttttcatcaaatttggaaagtttttagttgttatttcttcgaataggtgtccttcagatccctttggctctgttcacttttcttcattctctttttatgtgtgctcatcagactggataatctcaattgacttatcttcaaagtcagtaattcttccttctacctgctcaaatgtgctattgaaaccctctagggaagtttgcatttcagttaaagtttgcatttcagttattttacttttcaacttcaaaataactgtttggtttctttttataatttctgtctctattggtattctctgtttggtgagacatcatactcatactttcctgtagttccttagacatggtctcctttagcctttgaaagcatttaaaatagctgatttaaagtccttgtctagtaactccaactatgtctaggaagtcagggacagtttccactgattgattttttttcttgtgaatggctatactttatttctttgtatgtcttgtaattttttgttgaaaactgtacattttaaatgccgtggcaactctgaaaatcagattttctccactctgctcctcagagaacactctttgttgtagttgtgttttgtttagtggcttttctgaactaattctgtaaagtctgtaaacttttttgtgtgtgcacactgatgtctctactcatttagcttagtagatgtctcatgattggacacagatttcctgaaatgcctggaaccagtgagtgctcccagtgcttgctgaggggctctctatgtgcatgttggagcatgccttcactcagccaggcagtttacaactctgcggtagccttcacttctatttgtgtagcacctcaaagtcagacagaggtgcatgcttagggccttctcaagtcttacagcgccaacacaggcatgtggtcttataatttgcagaaatgcgtgagaacttgtcaaattctttatggatatctcattctttagcttttttttaaccatttgggttaatctattgtttgtcacaactgttatccatcaccttaaacagctatgacattaagcacatgcctttaaaattcttttttaaacacccatcagggagggagaggcttttagtactaggctttgaaagaaagctctagctcctttctgctcactacattgctgggaacttggactgctgtttttcaaggtgttcactaagctggggtaaggtagatgtgtctagggcaagttaaaatgcacaaagctcattgttcttactgagattcagctgtttttcttgaatcaagtgctttccaggttgctgcaagccttttgttaatttccagagttctgaaaaaatttatcctgacaatttttgctagtttttttgttgtttttattggggagtgaattcttggaggtcctttgccatgtttactgatgtcgcccatcataacatctcatccttaatacttaaatatgcattgaatgatattttcttccataaccacggtgccattatatgacacctaagcaaagtaacatttatttcttttttttttttttttttttttttgagacggagtcttgctctgtcacccaggctggagtgcagtggtgcgatctccgctcactgcaagctccgccttccgggttcacaccattctcctgcctcagcctcctgagtagctgggactacaggcgcctgtcaccacgcccggctaattttttgtatttttagtagagacggggtttcactgtgttagccaggatggtcttgatctcctgacctcctgatccacccaccttggcctcccaaagtgctgggattacaggcatgagccacagcgcccggccaacatttatttcttaatatcatctagtaccatgtacttattcaaatttcccccagttgcaccaaaaatatcttttgtaattggcttacttaaaccagaatccattcaaggattacacaatgcatttggttattataagctcttagtcttgttcattatttaaaatttgttaatatgacaattttattttattttttgagacagagtctcactctgtcgcccaggctgaagtgcagtagcgcgatctcagctcactgcaatctctgccctcggggttcaagtgattctcctgcctaagcttcccaagtagctgggattacaggcacgtgccaccacacctggctaatttttttgtatttttagtagagacagggtttcaccatgttggccagcctggtctcaaactcctgacctcaggtgatccgctcacctcggcctcccaaagtgtattatgacaattttattttttattttattttattttatttttattttatttattttttgagacggagtttcgctcttgttgtccaggcgggagtgcaatggcacgatcttggctcaccacagcctctgcctcctgggttcaagcgattctcctccctcagcctcctgagtagctgggattacaggcatgcacctccatgcccggctaattttttgtaattttagtagagacagggtttctccatgttggtcagactggtctcgaactcctgacctcaggtgatccacccacctcggcctctcaaagtgctgagattacaggcgtgagccaccgtgcccggccgacaatttttaaacatatgtaaaagtagaagggatagcacctgaatacccatagtcttaatactcagattctatagttgtaacattttgctatagttgcttgattcctctatctgtatctatctggctatctatagtttttgctgagccacttcaaagtcatcataacatattttacccgatggttcacgcctgtaatcccagcactttgggacaccgaggcaggtggatcatttgaggtcaggagtttaagaccagcctggccaacatggtgaaaccccatctctactaaaaatacaaaaattagccgggcggggtggtgggtgcctgttatcccagctacttgggaggctgagaaagaagaatcacttgaacccaggaggtggaggttgcagtgagtagaggtcacgccactgcgtgactgtgagactccatctcaaaaaaattaaataaggacatccgccattccccggtgtaaccacactacttttttttatacttaccaaagttagtaataattccctaagatcttcagatacccagttcataaccaaatttccccaactgtttacacaaaatatcttttataggtttttttccctcccaaaacccaggtctaatcaaggagggttcttttttccccagcttaaaacaaccaccattttcttatgttcatgtattctgtgggtcaggaatttggaaatggcacaatggcgacaacttgtctctactgcatgaagtctggggtctcagctggaaaaactttgaaggctgggggtgacttgttggccaagagtttgagtcatctgaagtctttcacttacatgtttgatgcctggcctgggaggacacaaaagactgaaagtgccaacatgtggcctctccatgtgactagcttcctcactgctcagcagcctcaaggcaatcaaactttttacatggcggttcagattgctaaaagcatgagtgttccaacaagcagtgtggaaactgaaattgcctttactgaccttgcctcaaaagtcatatagtgtcatttataccatattctatagcttgcaaataagcctgcttagattcaagagtggggcacagatctcacctatcagtaggaaaggtgtgatgggatttggggtcatgttttaaaaccaccacacatacaaaactatagagaacaatataaaagagatccaagtatccatgactgaaaattatgcgtcaacttttggtaaatttgcttcagatcatgttttaaacaaatgttacctttaaagaaagaatttcagccttccgaattgcttgttctagaatctgcatactgcttatccagaaattctcctttataatagcaatagctaaccaaggagtttaaatctaggtcagcagtaccaccacatcttttttctgtgacattagtttttttctttaaaaatataataaggctgggcatggtggctcatgcctatggttttggaggccgaggtgggtggatcacttgaggttaggagttcaagaccatcctggccaacatggtgaaaccccgtctctactaaaaatacaaaaattagccgggcatggtgttgcatgcctgtgatcccagctactcaggaggctgaggcaggagaatagcttgaacccgggaggtggaggttgcagtgagccgagatgaccccactgcactctagccttgggcgacaaagcaagactccatctcaaaaaataaataaaaatagaatagttcattgagctcctatatatccaccagtgagaatgaacagttattaatatattgccgtattggcttcatttatcactatcttgttttttaaatttttttctttgcttgaaagcaaaccccagttattatgctgtttcccccaagtatttcagtatgtatttctaaaaagtggatattttctcaccaaaccttacaacctgttattatacataacaaaactaacaataatttgataattctttatataattccaagtccataatcaaatttcctaaattgtcaaaccatgaaaaggtgtttttatattagatttgtttaaatcagggtctaaacagggtccatgtggcatttgaatgccttttaaccctctcaatctagagcactctccccttttttgttctgtgctattgatttgttgttgacactggtgtaattgccctgtagcatgtcctaccttctagatttgtctgtttgcttacttgtgacattgtctttttaaagagactaagccagtttatcttgtagaatgtctgcttgttttcttctggtgtcatttgtttttctgtacctgtttcctaaacactgaaagtaatatgaatggcttgctatattttagctcttcaacaaaactacttctcaggtgatgtgaatttcctattgcttctcatcaagaggcgtgtgaagttgtgttgtgctttctcactattagtgacagtaaagttcatacttaaagtggtaatctcttgatctcatcattataagttttttcttcttgaggtgaatgggtaatattttggtgctgtgtgaatatccaattccctagaatcaattgtttcattaggacttgccagcttgtggttttctaattctgtcattccttctacatttagtagctggctttcttctgtaaagaagagctgtctctcatcatttagggctgtttggttatcctgaaatacacttccttttgaaatggtgggatgagtatttttttatttcaggttggtaaggcattataaaagagtcatgcaagagggtggtcttcttcaggaactcatagcctggctggtagacagaataacacatcagcattagagaatgagacaaggtggtatgtgctatgtatcaagtaatttatacagatcataagttcaaaggaaaaagagatcagtggaaccaaagaggttttgtgtaggagattgatttcagcttaccttaaagaatgggtaggttttgaataggcagacaaaaaggaagatagtactctaggtggtgtggattttgaggatgaaagcatagggagagaggatgagctgtacacactctggagatgtaataaggaagccatccgtctggagaagctgagaatatggatgtggaaataaggttggagaggtaagtgggccagaagcagaatatgggacaaacttaaatgccagttcagggagattaactttttatttttattattattttattattattattattttttgagacagagtttcactgtgtcgccgaggctggtgtgcagtgatgcaatctctgctcactgcaacctctgcctcccaggttcaagcaattctcatgcctcagcctcctgagcagctgggactacaggcgtgcaccaccatggccggataattttttttttttttttgagatggagtcttgctgtgtcgcccaggctggagtgcaatggcgcaatctcagcttactgcaagctccgcctcccaggttcatgccattctcctgcctcagccttctgaatagctgggactacaggcacccgccaccatgcctggccaattttttgtatttttaatagagacggggtttcaccatgttagccaggatggtcttgatctcctgacctcgtgatccacccgcctcggcctcccaaagtgctgggattacaggtgtgagccaccgtgccggccaatttttattattattttattactattattattattattttttgagacagagtttcactgtgtcgctgaggctggagtgcagtgatgcaatctctgctcactgcaacctctgcctctcaggctcaagcaattctcatgcctcagcctcctgagcagctgggactgcaggcgtgcaccaccatgccgggataatttttgtatttttagtagagacgaagttttcgccatgttggcgaggctggtctcgaactcctggccacaagtgatccatctgcctcagcctcccaaagtgctggaattacaggtgtgagccactgcacctggcctggcttattgttctatttttagagacagggtctcactctgttgcccaggctggagtgcagtggtacaatcgtagctcactgtaacctcaaactcctgggctcaagcaatcctcccacttcagcctcccaagtagctaggactacaggcacatgccaccacacctggctaactttttaattttttgtagtgacagggtcccacctcaccctcccagagcaatgggattacaggcatgaaccatcatgcccagccaaaggaggttcacattttttttctttttccctctgggaggtttacctttatcctttaatcagtgtgtgctttgagcattggtgaattaggttcttatgtgatggcaagcaaaatctggcttcataaaaagctagaagcaggaagaccaatgagagtacctttggagagcttggaggtagggaatatggctagccttcggataaatgtcttagtgacaccttctcatcctgtttcccttgcagcccgcgtgaccccaactctgccgaagcaggaccgtcctgtgcgtgaggggacccgggtagcctctattgagacaggtttggctgcagcagctgcaaagctggcccagcaggtaggtgctgacaccccaggtcaccctgcaactaatagcagtttgacttagagcctcaacacttagacctgcaggctgataggatcccacctttgtctcaatggggattgagtaacctttgatctttatccttggcagtatcccagccccctcttaaatccctcttatcccaactcaatgataagctacttccacaggttacacagttgacatgattcaggatgaaagaaaatattaggccagagaaaaacccacttaccttttttggtgtgtaaaaacctctcagatgagaaggaccagatccttcctttgctctcatatgaagccctgagggggtgactcagctgagtacgctcaagttctcagccacccaccagtattggaatttggttgattagaaatttttcttgtcctctttatgaaataatattatcttaatcttcacccacaaattttttttttgtcctaaagagtgatcttcactagaatcaaattcatctcctagcattacatctaaaagttctttaatgtgcgtaatgtgcttaggagcctttggaggtgaattctctggttatcttgcaatcaatatcccgttagctcctaatcccatatcctatagcttagagcactgttaagcatctgctttgttagttgcttccatatataatgtgtaatgtaatctatctgcccaatagccctgttcaacaggtgatattttcatcattttataggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttcaagagtgggaatatatttaatttaacttggtatccccactatggtcagaaaatgtgtttagtcagtattggggtgggtgggtgagtgaatgaatgaatgaacgaaagaaagaaacagatctttctgtattggagatttcatgttggggaattagttaaaataagtaatgattataagaatggattctagagtcagcctgcttggatttaaattatgtaatagttctaccatttgggcaagttaatttctctttgcctcatttcctcatagacttcattttaggattaaatgaggtaatgtacgtacaagctcttttagaatggcagttgttatggagtaagtactataggcctgttagcttttttcatcattatcattatgggttggctaagtgtaaacagccagactgtggaagatcatgaatgtcaggccagggagtttgaacttgggcggggatctgctaacagctttttgagcaacgggattggcaaggtgaaagtggttctgtcataagatggtctagttgtctgtgggagtatctggataaattatatgtgaaagagattggcagcaaaggtagcaaaatttaggctagtgatctagatatgaagaggtaattctggatttaagtgagagaaaaagggacagaaatgcagttcctggtatggttagaatagcagtttggctgagggaagagattctgaagccaaatggcttggatgtgaatcccagtttgaccacttactggtcctgtaaccttagggaaatgacttagcctctctgtgccacagtttcttcatccttcaaatgggattataattcttacttcttgggtatttacaagtattaaatgagtaattatagaagagtggttgacatgtattactaatattgttattattgtaccccagaaatgcccgtggtagccacagcctgtgagatcttccgaaggcaggattaggcttgtgttgccaagagaaggcaaaaaaatgtgatcactgagttggtttgtgtggctgtgtagcatttcagaaggtgaagtgatttacatgctctcagcaccacctttccaggttctcagggctccagatgcccactatacaagtgtccaccatgcagtggatagtagatccatagggcagtggatggttgaaatacaaggtattgggagaagtgacacaactccttatttgtcattcccatccccaaagtgaggtttttagacccagtgacctggaggattgtcaagcccactgttaaaagaaaaagaccagcaagaggaagtgaagccattataagagatgaagatagaataataattaaccacttgtcgaatatctactatgtgctgtgtatttttatgtcatcacttaatcttttcaaaaatcctaaaaagcagatattattttacctgttttatagatgaggtagctgagattcagaaaggttagtcagtttgaccatagtcatccaatttagggacacaagcctggatttgaaccagatttatctcattccaaaactaataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaaggtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggtacaacggccatatggttgtagaaccgaaggatcttagagccacctgccctaaatcctaagtgctctagtagatgacaataccagggagggacactgaaggccaacctaaggtgcttggatttgatcttatgggccatggagagatgttgactgatttgaagtacagacaagatcaggttttagttttgaaagatccttctggtggccagaaggaggtagagggtgggctagagatgggaactctagggaggaggcacatatacaagttcaggcaggcaggaagagtacctggggctctgccagagggaatggagaggaaggagatgaactgatcaaatatggaggcagtcaaataggacatgggaggggatttaatgtggggagacagagacaacaaagagttagaggactgaagccttcctttccctcactttggtcctcaaagcccagtccctagagtacgcagctcaagggcatggaggttggtgtgatgttgaaggctgatgaagatgagagtttctaatgaagcaaggccctagggatggcaacttcagggacactgagctctaatcactaaccaggcacttgtccagtcctggtgggtaggataagagggtatggaagtacatttacctccctgcaggatcttggaaggaaaatgattgggaccagagtaatcagtggagaaaaagaactagacaaactgtaatcagggagtcttgctgctacaggaggtcataggaggaagagtcaaagcatgtggtgttggttggaagtagttaaggagggcttcctgcccaatatggtctaaggatggagaaactttgtgggtagagaaacaggaaggggaggtggcctgagggcagttggtgccagatttgatgttgaagcccttgccaaagcccttgcttacttttcccttcccccacaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagc

SEQ ID NO: 912 - DNA, 107233 bp, mus musculus; identical to SEQ ID NO: 911

SEQ ID NO: 913 - DNA, 174 bp, mus musculus
ccgtaccgccgggaacctcgctcgccttcccctcgagccccccgctgggtcgcgcggcgccagccgctcaacggtgcttcagagcagcctcctccacaacattcccctcggcccggccgttcgggcctactggagaccgcggcttgggcctagtctggcggccgcccggcgaac

SEQ ID NO: 914 - DNA, 136082 bp, mus musculus
gtttgagctgagccgaagcgaggaggctttcgactgagggctagcgaggggagcacggctggagcagggctggagcagggctggagcagggctggagcagggctgaagcagggccgcggaccccgcacgctcctgcgggccccgcggagccattgcggccgaggtgagcgtctatccctgggctggagggcgagctctgtacgcgcggccgttctcggtttctcgcgggtggcagtggcgaggttggggggggagttcccacgggaccctgcgcggaggcgcggaggtggcggccttggggagcctgcgggaaaggctgctggaggggcatggcggcctgccccaaccctccctgaaccccgcctcctctcccctcccccaggcctcggcaggcgccagcggagagctagccgcatcttcgggggcagcccggcagctgccggcggcgcggcgagagagcggctgacagaggggatgcgaggtaccggcattagccatggccaagtggccctaaagagagagtagaggccgggccttcagcgtttctcactggttcgaggaaggcggcctcagaggagagggaaggtgaggggcgggcaggcaggcttcgcgggtaactactaggcgttgcatatatatgttttgatatctaaatggtactacacacacacacacattcatttcgactaactgcttgtttaaaaatctgagaatatgtcttgtagatcttcttatatccgggaatccaaatttatgttgggttttaaacagctgcattgtatgattgtactacagtttatttaaccatttcccgattgatatacattagcttgtttctctgttgggggagggaggggactattacaagcaatgccataatgaatgggtttgtgtatatgtatcatgccatgtatgagtatttctgtaggagaaattcttagaagagtaaccgctgggtcagggtgtatatgcattttgaattttgatagatttgtccaaattgccttcccaaaagcctgtactaatttacactctttaatgttgtgcgagagtgcctatttttccacagttatgccaacacgtattatcaatctttgtaattttagccaatttaaagggcaaaaaaatcgtatgtcattgttttcatttgcatttccctgattactggcgaaattgatcatatttttgtttgtaaataggcaaatatcaatagtttatataggcagttttcctatctataagcaataagcattttgaaattttaataataaaaaacctgttcgcaatagcaagagaaacgaataaaaatacctagaagtaaactataaaactttattgacgaataccataaaagaacatctgcatgaaaagagaaggaatactatgcttctgaataagaaggctcaatattttagtgatgtccatttttcctatattggtttatacagttgatgcaatttcaataaatataccaagtttttttggaacttactatgattctaaagttcatccgggggaaaaaaatggctaagaataactgaaaaaaaatattttaaaacgtaagtaaagatagggatatttgtactactggctattaaaatgtactctaaaggaactatttaaattagaacggacagaacaatgcattagaatggaaaagcccacaaatcaagccagattggatcccaagatttattggagaaacactgttggctagacgtggaaaaactgccatattaaaagcttcaggcatttccccccatccccgaagcttgaatattcctttgagggcagactcctttgtttggagaaaaccactttattggatctttttggttatgccaaggtaaagcttcagtagttaaaattggtggctttggaactagaactaatgatatggcctttagttagattaagatggattcaggttagcctgcagtgcggcgagggaaggagtctggataatgtaggtttaaaaatttttttccctatctaatgggcaaaaaatgttatgtcattgttttcatttgcatttgtgtgcttactgtgagattgaacgtcttttaaatgttagtccaggataatatgttattcctggagacaggtaacaatgggggactctttgctccgcttccagaatggagtttggctaattggtacagccttgcccggaagcgtgagaataaacaggttgactttttaaattttcctcaagcactaggctctagacacctagatcgggggcggaggcagttttcaggacatggccgagatttggcgctgagctgtgtcatcgcgaggtttggcagccagctccgcagtgggtcggaaacctcgtggtaggcgagatccctgcaggacgggagggttcctcccttcccccgaaaaactcccagtcattttcatgaagctccgcctttctcctttttaggagtgtgcaccaggtctcgcgatatctcatgtttcctaaaggcgaggcgcgggcggcatcctgcggtgaattaagaaggtctcgccgaggctaaagcgtaatatcgcgatagttctcaacgcatgcgggagccggccgtggtaggttggctccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttctttttatagaagcccaactttagactttttatcatcattagttaggtgccctgttaattttaggtgtgttttcctacgtcttcagtagagaaacagaatcagaacaaacaacttaaaagaaaatggcttaggaaaagaagtgggataactgaactaaaggcctaacatacagagctttaagtgggaggtaaataggcagtctgttgaagatgaaatagatatgctgcccatggaagtccatgaccttcggtataattggcaactggaaatgccttggttcatttctagctatattacatactgattttaattctgaccaactgcttcaatgtattggtgaattttaattgtatttaaaagccaaagtaaggccaggtgcagtggctcatgtctgtaatcctgacactttgggaggttgaggcgggaagatcacttgagcccaggggttcaagaccagtctgggcaacatagtgagaccccatcgctacaaaaaatacaaaaattagcggggcgtggtggtgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacagaaaagaaagaagcgaagaatacatattaaaagaaaaaatttgggctgggcatgatggcttatgcctgttattactggcacttggggaggctgaggcaggcaaatcgcttgagcccaggagtttgagaccagcctgggcaacatggcgaaatcccgtctctgcaaaaagtacaaaaatccgccaggtgtggtggcacacccctgtggtcccagttacttgggaggctgaggtaagaggatcacttgagcctgggaggtgaaggctgcaatgagccaggatcgtgctactgcattctagcctgggcaacagagtgagaccgagactctgtctctaaaaaagaaaagagaatatttgttactatttgtatgtaggtgatgagtctctttgtttcttggggagataatgtaaaattattataactagtaaaagcacagtgaggtagccaagagatcaatatacagaaacagatagctcttccatgtattaatagcaaccaattagaaaatgattggtgaggccaggcgtggtggctcacgcctgtaatcccaacactttggggggccgaggcaggcagatcacctgaggtcaggagtttgagaccagcccggccaacatggtgaaaccccatctctactaaaacaatacaaaaattagctggacgtggtggtgggcacttgtaatcctagctactcaggacggtaaggcaggagaatcgcttgaacccgggaggcggaagctgcagtgagcctagattgtgccactgcattccaggctgtgtgacaagagcaagactctatctcaaaaaaaaaaagaaaatgattggtgaaaagaccccattcacagtataagcaaatattctgtctgtaaaataagtcatattggctaaaactgtaaatttaagagcagttaatgtaggaggttgtgttgtaataacaatggtggggaaagaattcttaaaatccccatggcataaacctgaaagtaaaattttgaatattgtatttaaaaatatacttcccaacaaaaaacacatagctccaggctactccttaggcccttacactagaatataaatcaacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaaattcatgtgagtagatgcccatactcagtaattagagaaataaaaataaaacaaggtacagctttgtaagcatcagatttgcagaaattagaaaactatataatggtaagtcctggcaggtatgtgaagcaatgggaaccctcatacattgttcataggagtgtagactggttctcatgggtatatatttcaaaggtgagatcgcatcatttccataaacgtgatctctgtcagagtattgcatcatcatttgtggtagtgaggagttggaagcaaccttggtatccatcattagtagatactcaaataagtaaaatgtggcacatgcacactatggagtatgtagcagttagaaacagtggaccaaataatacagcaacattgatggcttctaaacatagtggttagtgcataaaaaagtaaaagcaacagttttcattgctcagtaccatttctgaaacttaaaaagatgtacacaatgcaacatatagtttcaagaaagaaaaattaacagacatcaaaagttatacctttgatagaagggaatctgaatgggcaataatgggacagatacatgaacaagtacagtagtctccccttatccgaggtttcgattgccatggtttcagttacttgcagtataatacaataagatatattaagagagaagccacattcacataacttgtattatagtatatattaaactttatcatcagtatgtatgtatagggaaaaaatgtgtgtgtgtgtgggtgtattatatagggtttgccactacctgtattttcgggtatccactaggggtcttggaatgtatccctatggataagggaaaataaatcttaccagcagtatttaagatctgttagaccaacactaaacctttacttacagatttaaaagatggtctaaatagagacaagtaacattttttaaatgggaagacttaatgtagtagaagccctttaatgaaattaggaccaatgattggtagtttaattattttaaaaatcttgttaaagcaggaaatgtttaaaaagtgattgatacatatgattttttaaaaactaaaataattccctttcccatcttatgtgggccataagacttagtaagaagcagtctgttttctgacataaactacaactataatctgtgattactttatggtgttgcaccgattgaagaaaaggagcctgcatacaggattctaaattttttagagtttacccctgaatctcttcataatttgacactttttattttagcatcttgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaaaaacttgacttgttcatgtgggcttcttttatttatgtatttattttttttgagacagagtctcactccattacccaggctggagtgcagttgcacgatatcagctcactgcatcctccgcttcccaggctcaattgatcctcccacctcagcctccctagtagctgagactacaggcatgcaccaccacacccggctaattttttatattttttgtagagatggggtttcgccatgttgcccatgctggtctccaactcctgagctcaggcgatccactcgccttggcctcccaaagtgctgggattacaggcgtgagccactgcctgtccttgtgggcttctttaacaatgctcatagaaatcttggttcatgtcttttcagtcttttcaggcaacttcctttgcaacaaacacattcacttgcatgtgtataagaacctggatttggatgtgaaacctacttttgccaacaaatattaacctgtttctgtgtctgtaaattgggggttacaatatctacctcatagtttttttaggatcagagtaaaggaagtcataaataaaacctgtagggttaatgccatcatgttggaagtacttaataaacagctgtcatttgtagatggatgtcaaccagagaaactacatgccattcttttgtatttgctttcttttaaaatgttacacatgcattattttataagtgcatgcatattgtcacatgattattttcagtacagccttttccctcttggttcacctccccataacctcaaatgtattcttctctatatattatcttcatattatattgactgttgagggtgtttttgtccttcagttacaaatgcaggataccttacatccttgttttcttatttcagaccttgttcaaaaatcactttaaagtcacctgtataactatagggttcttttgatggctgcatagtattccatgctttggatgtaccatattttactcaagttccctattgatgcatacttatatttgttatgaatgatgctacattaagcaatcttatatatgaatttagttactgatacatttaatatgatattataagagatgatatggagatcataagatagagtcccagaaatctcagtgtgactttattggcacttcactgatcagtaatgattttgagcatctttatgcttggccattaggatttgttcttgtgaaaggttttatcttttgtccatttttccatttggttactttttcctactctgtaaaaccatattggagatattagtcctttgtcatcttaaaagtattttttcccctaatcttcatgtatattgtctttgtttattgtgttttgtatgtgatgttttcaaaaatggttcagtcaatgcttttatataaaagattgaatatcgtgttttggtctttatgaaaagtgactttggatatggtgtctttcctcatagtagtttttaatgactaggtcaacccagtgatgtgggctaattgtgaatgtgaacagtgattagttaactacagatgtagggaaaattctccagaaagacttgttgaatcagttgaaagccagttggctggcttttgtgaaggtctggtatactctaggtctagtaaacttgaggatgcatcagaatcactttattaaaaaatatattagtcttcctcacctccatcccacctaactcctgagttgctgattcattaggcttggagtgggcctcagaatttgcattgctataaagttcccaggtaatattaatactaacctgctggtccagggagaaccactggcctagtctattttattaagttacaaacttttatcaaattcttataattccatcttagagagcatcaagcctttttcctgatgtctgaatatttagcaaatcctgtctagtgtgaggtagtgttgtatatgcctctgtggcataatgaatatagttatttatgggttatctacttaagggctaggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaattccgacagtcagtttattcactgtttttgtgaaggtgtgggcttatggggttccccattctgccattttcactgacagcattcctagtagaacagtctgtttttaaccagctgggagtgggggatatacatatctgtgtccaggcagactttctcacttaggttttcactagagaagtaagccctaatgccctaaggtatccattattaatgtagcaaagagacttctctcttgtgcatctaaggtggtgctagttatgtaccattatttggagaataaaatgatcattcaccatgttctgtgtttcatatatgatacctggattgagaaatgctgccagtagatcaagtgtagtttgagaaagcttatttctcacaggatagtcagatgatgttttatttattcatttatttatttacaggtttagaaatagcattctatagtatgtacctttgtgactggcatcttcagtggtttacactgtttgtttttgagacttctttggcaagtagtgatataatagcatttaacaaagaggaaacacttagatgtagagagagagccatgttagttcatggtggcagcccagatccgaggtgattgggacccacactagacaggaataaaatgaagacatagaatataagtagcattttgtgcttcaatcatgccagacttaaaaatatgataatgcttggctgggcaaggtggctcacagctgtaatcccagcactttgggaggccaaggcagaaggatcacttgaggccaggaatttgagaccagcctgggcaacatggcaaggctcctacaaacatttttaaaatgtagcctggcgtggtggcagcatatgcctgtagtcctagctgtgtggcaggctgaggcaggaggatcctttgaccccaggaatttgaggctgtggtgagttgtgattgtgccactgcactccactccagcctaggcaacagagggagaccttgtctatctctcacactctcttcatatatagctacatatatataatttttatttttataaattttatataaaatttatataatttacatatttataattttttaaaaatatacaaaatatctttttatatgaaatgttttatatttgtaatataaaaatctcttcagtttgacataacaaattaataaatttgtttcaaataatatctcatttctttcacttcgtcaattgtttgcctgaactatatgccttgccccatgaggcagggagatatatattttttacatatataaatacatattttatgtaatatatgtaaaataattatgaatgatttaaaaataaaaatacgttaatgctcttaatgttaaagtgatattttaaaggctgttaagatgcaggctagttagtaagtgagactatgtggctgaagttttgtatttagaagccagttgagccactccccccattatctcaggagcttgttgatgaggttttagatttgagtggcaaagtacagtagtaataaataaggtagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagattagatcaagttactttcccacgttagctggcatacttttctttagtgattattttatgaagagatattgggtgatacagtaggtgagtgttgtctgtttaataatcaaaactacataaatcttgaagtatattcagagtttggaattctaattatgacaacataaaggttaacgtgtactttaaaaggaagtaatacatatacatgttaaaaaattcagagtataaagaggtatgcagtggtaacttcttaattttccagaggcaaccactgcaagtggtgtctttcagtgagacattttagtgggcattctgctgtcatcttaattttgttcatcatgttgcttttctagagttaaagagaatgttttgtcagggtctggtttatgttgtcttggtatctacctgtgcagaaaacataccatgagaagtggtgtagaatggtatagaaggaaagtgtttgaagaattatgaagatatgcctatgaggcatactttgaattaaatatttcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagtagcttagtgaaaatacaatttctcttctacctatactattcaataaataaataatctttctagcttaattgccttgaaagcaactctaatacatattcagagagaaaatattttcatgaatttggtctttgctattaatactgctatggatattaagtcagtggagggttaaaaaaggacaaagaagaatatgaaatgtgcctggctatgtgcattatagtttgatactactggttttaaaggagctttcctaagaatattctacatataagatggatgttttggaagattctcaatttaccttgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcattcatctttgttgctatgagtcctattatagttacctaggtagcaacttaaatacttccacccctcccagtgttcactgtatttattcattatccttgagctccttaatgttggacgagaaagagggtatgatgatgttgattgacatgtcacctgggtttattcttggtattcgtctctttttttttttttttaatagatatgcttgtagctatcgttcactgtccccctactctttctcttgccattgtgtcttcctcctctctcatcctttcagggatatcattttgaattaagtcacaaaatattcagtagtcaatactgtgcatttaacttcttttactgtggcacagtaaaatggaaaacacgtggttttgtaatcagtcctgtactctgtccctgattctgtagattattagccacacttatcctctcagcctcagcttattcgtttaatattgaggtactcaccgtagaggctggtctaaagattaaatgaaaacctagaaagcaatctagcacagaacaagcacatagaagatataaaatggtaaccattgctgttattattgatgttcattatgttatgacttgccttctcttaaactatgagtttcttggcgtgaaattcttgctcttttatgtgtactcatatctagcatgatttctggcatgttagtgggtgctcaggaaatctttgttgaaaactaaatgaatatgcctaaatcccattagtttatgcttcagggtactgtgtccggtattaacctcatcgtggaattcattgaatgtgaattacacacattctgaagttttactacagtgtcacacaaatttctgacttactctgcaatggtccataaattctgttctttacaagtgtttacagtaaaagcagaagcataggaagaggctaaaatggaaatcttatattgaaggcatagtggagttacatcaagtagtaatgttatgaaaaattaactcagagcttttcctatttccatccccaaaattctttctcaagactaataatacctttagtagtggaatctgtcaattcagtgtctgtttagagattatcagttgtatttgatccagtccttcagaatttaatttggtgatgattctgccctccattgctggttgggaatggaattcttccccagaacctatagataccaaaaagtttgttattgggcagtggcttgaccactgccttcttgcctaaagtgtttgtttctccttttgcagtgtattccaatgccttgcaggaatcagcaaacagtatcttgtataatggcttgatagaggagttggtagatgtccttcagataacggataagcagcttatggtaagtattttacaggttgagtaacccttagctgtaacacttgggaccagaagtattttggatttgagacttttttggggggggaggggatatttgcatatacataatgagacatcttgggcatgggacccaagtttaaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacatgttttcccccatactgtgctgccttactgaggccccagactacatgtatacaaaagcatgcaatttttacaactttgtgtctttatagttcattgtttttgcctctttttctccgtgataggtcataaagtttcttggcgatgaacaggaccagataacatttgtcaccagagccgtcagagtggttgaccttatcaccaacctggatatggcagcttttcaatcccatagtggactttctatcttcatttatagacttgaggtattattatacaaggaatgctttgcacagaatttaatactcagagctgaacctaaggattgtcctgataaccctaaagagcgatcttacagtctcttctgtttctagaaatcaactgtgtatctgcttgcagtgtttttccattataatagtttttaatccctgaaaaaatatatatatatatatatacttgattttcttataacctttctcttgattgtagcatgaagtagatttgtgccgaaaagaatgtccgtttgtgatcaagccaaagatccagagacccaatactacacaagaaggagaggaaatggaaactgatatggatggtaattaacagttattaagtcagtatttttgtgcttgagattttttgtcatcccaccccagttttcattcttcctcataaattccaaagtacacaattaacttgagtatatactttcagcaacaaaaattttttttctatgtaagtgatttgcaaatttgtttttcacaaagataataagaaaagaaaggtactagttctttggagtagagatggcaggtaaagcagatgctatagctgtggtgttaatctgttttatttcatcacgtaattttcttatgtatttcttattgtcttatttctactaaaattcaagctccatgggatcaggatattgtctttttcactgccgcagtgcctgataacatcctaggtgttagaaatatgcttggtagagagagagagactaaaatgggaccttttaaaactttacctattttgagaagagaaaggagaggtaaaaaggttgttgggtaggcaacaacatccgttaggctggcacatcacttgagcccaggggttcgaggccagcctgggcaacatggcaaaaatcttgtctttacgaaaaatacaaaacttagccgggtggggtggcatgcacctgtggtcccggctacttgggaggctgagttgagaggatcatctgagcctgggagtttgaggctgcagtgatttcaaaatgtaaatagtattttatcactgatggagccttaatacattttataaactgtagtcaatgattgtgtatcttatactcagttattcaagtgtataaagtaaaaatgaatgctcacttacctaccatagctactagtttcggtgcggatctttccaggcttttttatgcatattcaaatacatgttgatgttaagtatgtatgtagtattttagaatgggaagatgagatcataaacatactgttcatcttgcattgctcattcagtgtttcatagacattcttccagatcggaatattgagtattaatcttttcatgctttttatatttattaattactcttttgaaaagctgtacctatttgtatactaccaactagtagtatatgaaattgcacattttacttaccactctccccctcttccccaatttggtaggtgagaaatattgaaggacttctgtaggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggttaaagcgagtctcctgcctcagcctcccgagtagctgggattagaggtgcctgccaccatgcctggctaatttttgtatttttagtagacaaatatgaatagtaaaatcctgcaaggatataaaacacagagaggccgggcatggaagctcctgcctgtaatcccagcactttgggaggccgaggcgggtagatcacctgaggtaatgagtttgagaccagcctggccaacatggcaaaaccccatctctactgtctacctggacagtagacaaatgtcaatagtaaaatcctgcaaggatataaaacagagaggccgggtagatatctgtcttattggtgatgaaataaaggtcagaattcagttttaagtaaatacctattttctgggtgctgaatataccttcgataagtagtacatttgtagtaagtaacattatcatacattttgtttatctgtgctagaattcttaaaacgctaaaggaatttagtaggagacgtggaaatagggaaagtctccttgtagtagcaagcattgtgttttacagtttggggtgttggggagactagttttggctactacaacttagatacttccttgcccccttgctgaagaaatttaggatttttgtatattaaccttgtatcttttaatcttgcacagttcacttattagtacatacttgttttgttttcttagaatattctacataatcttgtcatctgcaaatgcatttttactttgtttatggtctttgtgcctttttttttgtcttatgacattagcaaagatttctgatacagtgctggatagaaataagaatgggcctctttgctttgttcctgaatttagagggaaaagcatttaatatttcaccattaagaatgaagttagcagaggttttgtgttgaaggttttgtcaattttgtcaggttgaggaagtcttcttgtggtgtagcaactctaccatgctatggaaaagctctctgctaaggttatgttcagatggcaaaattcagacaatagttctttggggtttttttgtttttttttaagatttgttttacggtggggacgtctcaaggccaggggcagggagaatgcccgtcttctgggagaaagtccagaacagagagaaagagaaaaggatacacaggcatttttctataaatgggaagcttagaagaaggagcaattgccattgacagggatattgtttaaaagagggaggcagcaagaggatatagtgcttaggtgctgggatagtggtgaggagcaggtgagccctatgaggatgatgccagaagtgagggacacgggcaggaaatgagacttagagcactaaatcaaaggtcagtgaaggtccaacttccttccctatggttttcttaattcatccctcacatttaaattagcatagcaacctcccagttttcccataaaatacacttgtacttgagagagaacaaatttgcaaagcgaaacctaaataattagactagccattgttattttagctccccaaatgatagtacagagcctttcactccaggtggaaggagatggcccaggaaagacatcagggagttctgagaacctcttggagtattttaataatataattggcagtttgggtttatttttgttgaactattctggataccttttctttattaatgatcatgcaacaggaagtccctttaaggcacaagcactatcttgaaatgccagtaggtagtttcatgccagtctgttatcaactatcatagtaactaaactgctttgtccctcattgagggcttcttaggcctgaactgtttggttaatgtggtctgtcaggagttacaacatgtctcggtaacctctatgagttgagtctgtgttacagaattggaaatacctaaacttgtgcccgttacaccaaagattctgatgaggcccagaataggtaaaaagtgctcctttttgtggcaagacttgataaaacagctagactttctagttgaatttgaggtgccctgggcactaaatgtccatagtacataggtcagcttgtatgggtagaagggaacaggatcgctgaataaaatgtataaccctgctgagcaggagttgtaacacagaagaatcagtagcccaagaggttggaagttggagtttctagggggcaaacttatatcagggtggacattctcaacaggggggcatcattgtatgtactatcagttggtggcagaggctgggaaagacatgaaatccttaagggggaagtttaatatggaagcacccagtgaggtcacgatgtcctgcttataatttcacactcaaacccactaaatattctgactccttctccctcacgtgtccgacctctggctcttctatgccacttttagccacctgtatttcatttgtagtatcccatttaacttccccaactcccctctcttctttctcacctcctgccttacccctcatgttatctgttcgggtctgtttgtagcctatgctaatgtcatcatgcttatgattgaccacttaaccagagagtgtagcaagttgtcaatatgagtattgaaatcctccaagggagcaagatatagttgtatgagtagttgcctgggctagggtatctgttagtattgctggaggtttagtatgtaggtggcattctctgttactaatacatagatacaatctatcaggttgagtgaggggaagcaggaaatataggtagtgactggaatagtgaaattagagtgtaaatagtgaaagtggagtgtgggctgtcaaagagttgatggggcagtggagttatgatgagttatgtgggggcagttacaagggcagttaccatcttgagggtgttagcgtcaaggctgggactgtcagttgtactgaaatcatcatctaggatgctttggtatgctggatggatagaagccctaggctcgcacttgagaaattattataaaagtaactcagtatccctttgcctacaagagttttagaataatttcagatagggaagctatgcactgattacccctaaacaagtgggatcacagcatgggcaaaaaggagcccaagaagtttggcattgagctggggtagtagtatcccagacccagaccatgagccaaatgaggtatagacaggccaactagagccagaatattccacaaagatattttcaggcctgtggtgcgtagacttttggcatgccgaagtgccagtttattatgggaatcacaggcattgccatcccatatcctgcaatagtctcccattcaatacctctgtaataaggtggttccagaactggcttcctgtctaagaatgttggtactaggaactaacttaagatttttctttcctctttggaagaaccatacagttgtgtatgtcaacccaggcagagagactaagaccttcatttcctatgaagagggatctccagttagcagtcctttaaaaccatcatattaggaaaggactttggcagagaccttctgcatagtcttagagggtgagggccctcaattttctgtgggtcccatcctgttacctactttcaacctaggctcctgtccaccgtggatcgcaccaatatcaaatgaggaggtgtcgttaagtgagggggattctgtttgggtattatagactcatagatggaaagtatctcattttgaggctagaaaggggacaaaggaagcactaattgtgttttttcagatgtcatacaactaaggcaatcggcaaaagagagatcaatttaagagaccattgtccatttagtaagtttaagagagcattgaacaagccattatgcctctattaggcctgctttctgtgaacagtacaacagatgggccaggcactggctcacacctgtaatcccagcattttgggatgctgagacaggcagattgcttgagccttgagcccaggagtttgagaccagcctgggcaacatggtgaaatcctgtctctacaacaaataaaaatgtttgcagggcatgctggtgcgctactcaggaagctgaggtgggaggatcacttaagtactggaggttgaggctgtagtgagctataattgcacccctgcactctagcctggggaacagagtgagaccttgtctcaaaaaaaaaaaaaaaagacaaatggaagctccaaggtgatgccttgtttgaaaaggcccatgcccagactgaatgagcggtaacgtacgtaccctggtcagagtcggtgttaccagaagcccaaagggaactaactgagggctataatagtggtggtgttggcagtagttgggcaggaaggataagccaagaatgggtctgtataacaatcagttgtgagggcatagcgatttgtgccagcagattggggcagtggcccaataaaattgatttgccagtgagaaaaggagtgtttacctctggtatggtgagcccccactggtgatgatgccgatggcacgacagggcacaaagaacatattgggaggctagggtttgagtagggctagtggcatggggatgcaatggcatttgggcccagggactgtgatgaccttctgccttcctttactctcttctctgtaaccttgactttccaaactctgttggattcattttcagttctattgaagtacatctgtgggtaatttttaaggtgtcagacttctctttcagaagttggtggctgttttcttcattgtattctaatgctacattattgtagataaccatggtgtcacactggttcttgttcttatctgtatatagttcctgcttctgcctttttttttttttttttttttcttctatttctctgattccttttaactttctcctggaaaccctaattaccttttttccatttcttagttgcttggttccacacacagctggttgctctgtgcgtgtatataccctttaattctaattcttggttatcagtgtttttgtataggggtcccagtgcatagtgtcgttgcgacttcttgataaaataacaggtttgatgtcttagtaattgcttgtagaacactaattttagtttttaaatactcaattttagtaactctatagaattcatacatttctacaaatgtaagtcaatcgaggggagtgtcataccaataggaaccccaaaaaggacttaaatttttcagaagtttatagcccatgaggaatcccaaaggccattgaaaactgttggtccccggtaactgctatatatctgccattcccctagcatttgggataaaggagagatgctgtattcaccatcttgaatagaaaatcctctggtttcttttagatcttaggcatcaccataaacaagtttgttctgtatacatggtttatgggtgttgtatgtatattcctcttcatcaggttttttaattaaagttattgtagttattgtagtcttatgagttgggaagctttgtcttaattattcctagaaggtttaataaaactattggcttggtgcctctctattacctggattttttttttttttccccttttaaaaattctggaacgggcacggtggctcacgcctataatcccagtactttgggagactgaggcgggcagatcacctgaggttaggagttcgagaccagcctggccaatctggtaaaaaccccatctctactaaaaatggaaaaatcagccaggcgtgttgggtgcctgtaatcccaactacttgggaggctgaggcagaagaattgcttgaacccaggaggtggaggctgcagtgagccgagattgcaccactgtactccagcctgggcgacagagtgagactccgtctaaaaaaaaaaaaaaaaaagaaaattcttactggtctagtctgctttgctgtcacttcctgagatttgatttttatgacattttcttattaaactatacatttcacttgttggcatatagtttgtagaatatatttttctgtatctagttaaatctcctttctcattcataacgtatattactgctcttttttctaatttatattatttcacttgttggcatacactttgtagaataaattttttttttctgtatctagttaaatctcctttctcattcctaatgtatattactgctcttgtttctaatttatattattgctctattttctataggtttataagcttttccagtgtcttcacaaagctagatattggcttcgtttatcctttttgctttcgttttcactgaattcttttttctgttaattcttcatagcttgtttggttactttttaataaatactttaatgctgtactatttcctcttgagtagagtttttcccatgttccagaagctttggtagttattactgcacattttaaaatattataatgtcaaaaactgatcagattaatattcaaggactcttgcattgctggtgatagtttaaaattgttgaataacctttgtatgaggcagtttatctattttcatcagtaaagcttgcatttgctttaacccagcaagcccacatcatagattttttttcctgttaaaagcagacaaaaacggatatatgtttaggtttatcattttcacaattgaggactggtttttatacatgtggtacatgcatttagtggaatagtaggcagccattcaaaatgaatgggtcgttgtgtcgggagaggacattatacggtatgacagttgtgggggaaaagcaaaatatataaaacagtgtaacctcatttatgtaaaaatatgcccataaaaatcctgtaagtgtagtcactagattctttatagtattgaatctctgatggagcagtattaggatctttaatttcatagtaagcacaagggtttaaattgctagacattgagtatgtatttttttttaagcttttggtgttttgttttcagtttctgtgaggaatctctcagttttccatattttctcatctttttttagctactgaagtggtgactgtgtttgtatttcaagaaccatcactgctctcctcactccaggacaatggattgacagatgtcatgctgcatgcactgcttatcaaagatgtaagtcttttctgctactctgtaaagaatgtcttagggcgtgaaaatcctatctcttctgtgtgtagtgttgaatctaattgggacctggttgtcaaaattccttctatctcagcttgatacccatggccggattttcctagcatctacactcttttagatgcattcaagctcactttgttttctctttaggttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttgttaagatttattttatagtagaaaattgatttagtttgcaaggaaactcttccttgatcatctctctcatcgttttactggttaggtgtgctaagtttaatgggaattatcatcatacattctattatacttcagaaggaatacttcagcttctctgctcataatatttccatgcttctcaacagttcaccattgtactttcatggtactggtagaaaataggtattaagaagcagtggtagatttccaggttcaccatctggtctgcagcaatgagaaatatggagtcctgaggtgttcatctggtaatctagtgttctgatgtccaactctctaagataacgacacatggatattttttttttactcagtatacttgagaccagataattgagagattattagcaaaaaggtagggctccagaaagattacagttttcaaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaaccaaaaaaaaaaaataggaaaaaaatatcacaacagcctggcctggcacagtggcacacacctaccattttgggaggccaaggtgggcagatcacttgagctcaggagtttgagaccagcctgggcaacatggccaaaccccatctctaccaaaaaaaaaatttctccagtcacggaggcgcacacctgtagtcccagctacttggagggctgaggtgggaggatcgcttgagtccaggagatcgtgacactgcactccagtctgggtgacataaagtctttaaaggaaagaaaatcataaccaggctcagtttcttctttccactttatatgttggtacagaaaagagcccaagctctattttcttcagtctttctaattctaacagttcattttttgccttaaggggatactgcatccaacctggggagtgctgtcgatgagctcatgagacatcagcccacccttaaaacagatgcaacgactgccatcatcaaggtagaaagtgataaggatgtgaccatgagcatgagagagcagagaaggggaaggttttagaagattggcctactagaggtcattaggattcttgggctatagctgtaagagcattatgtctgcctcattgtttccatgtccttaggttggtcctttataaaaagatgttgtcattttagttcatcttagaaagaagtctctgttaaaatttttttagcctgggtgcagtggctcacgcctgtaatcctggcactttgggaggctgaggctggtggatcgcttgaggccaggagtttgagaccagcctggacaacatggtgaagccccgtttctatgaaaaatacaaaagttagccgggtttggtggcgtgtgcctgtagtcccagctactctggaggctgaggcaggagaatcacttgaactcgggaggcggaggttgtagtgagccaagatcatgccactgcaagactctgtctccaaaaaaaaaaaaagtattttagattgagaattgttttccttaaaaatttttttccatttaatgtaacctgtatataatgatttcttttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaattgtattggttgccttaggaagtgatctttttttaaaaaaattaattaatttttaatttttattgatttttttgagagagagttttgctctcgttgcccatgctggagtgcaatgatgtggtctcggctcattgcaacctccacctcctgggctcaagcagttctcctgcctcagcctcccaagtagctgggattacagacacctaccaccacacttggctaatttttgtatttttagtagagatggggtttcaccatgttgaccaggctaatctcaaactcccgacgtcaggtgatctacccacctcggcttcccaaagtgttaggattacaggcgtgagctaccgcatccggccaggaagtgctcattcttaaaagctgttgatgaaattgaatcagaatttggtccatcaagttaatggactttgcacagagaccttattttccctttgttgatttgatattccacatcgactgcttgatttttttcaggcacgtgtgaaaaacaatgtacttttgaagcctgtctcctaagaagtccttaaggggtgtgtgaagatttgttgttgcttgttgtttttttatttttgttcattttgttactatctgttcgttccagattaattagtagaaggctttggaatttactatatgactgtaaatagtcaagaattgactgcttagatggaagcagggagtttgcttaaaggcttagtgattggtagggggtagtccaccaggctctttgagcagtattcacataccagggatgaactgtaactgtatacctgtaacttttagtcacctgcatgctgaaaatgggattgatctttctggacagtcctgcactccctcatataataagtggtcttttagtgtgtaggtaagtcattctgagaaaagcttgagcattttaggcacagctatgaatgcatttgagctggtcctgaatggcaccttgggacttaaaatttaaggtggagttgacaacaggagcaaaggcctagaatccgaaactggtatgtcctcttggaactctaaatagtgatgagcctgtgggtgtcaagtgttttaaggagaggcattaactactaagtatattgctttgttgaacagataccttaccctgtctgagaaggcaaacctatcttcattctagcagtatcttttgttctcttttaaatgttctttttctagaagaggaggacaccctggaaaaaagcacgacttttttttgtagacgagtcttagtgcttcctttgtcacacccttgaatgtcagtgaccctactggagtgtggggttccttttcctggctacaaataaggaaaaattttaaggtgtaggtggtggtggttttaattcaagctcatatatattcatctgcatgtgacgtccctacctggatattttccagatgccttacatctgatgtgcccagatttcaagctgacacagttaatcagcacactaccctcatttgcttaccctcctttcctttcttgggctatcatgtatcactgtgttctatccacagccatccccattcccacatcacctccttttacatccaccagatttctgtaaggctagttcaaatgtcttattcttgaaggaggtaggttggttggttggttggttggttttttacctccaaatgagaactcaatcttgtgttctcccaacagttttgttaaaattattcatacatgttaatggttttcctcactcacctataagctcctcaagagcaagacattgcctcattcaccagtgtatccctatcactttgtatatagtaggtagtcagtaggtttgtttattgaaatgaataaagagccttaaatgaaggattcctgaagtcttaaatgcttagagagctaggcctaatgagacatgaatgaaaatgaagagaaattagaaatataaacccagtagcattaatattctaccacagtgatagttatatgtaacttctaagatgcagaggactctagtagttactgtaccccagtatcagtagttttctacattctggatgctcatcactgcctcatttggataatccaggagtctcacagatgttgacacatacattttttcacttttgccatcttcagaggcctagattgggtcactaagtaaattattagggaaggaagaaaaagcaagagactgtctaaacttagcttcattttgaaaaccacaatatattaacagcaaaagttctttttatcttctatcccaggcaattgttataggggaattgtgtactttctcacaatatggtgaaagggcttagaaagatttggaatatgtgtcacccttctccccagaagtcttgcccatcccttcctccatatccatagttcttccgaatttctgtttcccatgctctcatttgttttccaatgccttatacacacataaaatgattaacttttatctttattttattttatttatttatttttttttttttgagacagagtctcactacatcacccaggctggagtgcagaggcacgagctcagctcactgcaacctccgcctcccgagttcaagcagttctcggtccttagcctcctgagtagctgggattacagacacgtgccaccatgccttgctaatttttgtatttttagtagagatggggttttgccatgttggcctcaaactcctggcctcatgtgatccacccacttcggcctcccaaagtgttgggattacaggtgtgcaccgccgcacctggccaatttatcagcagtttaaattcaggtatgatttccatacagattttacatttccagtttccctgcccaaaattgagactgttactcatcttacttctgtcatcatattattatgtctattccagaatatgtttaaataaaatgaccatataaagtcttatgtgtatattatatctgacgtatataccttcttgtatctagcttctttgtttgatgtgttttggaggttcatccatgttattgcatctgtcagcaacttgttacttttcattgctgagtagtattctgttatgtgataattgtatagtgattatccattttcctgttgatggacttgggtttctgagttttttccaggcttagacactaccctttctttttttttttttttttttttacaaaatcagcagctagtatttgcaaatggtgtttgtatttactcttgaaatacatggttttgtgctggagatttggagtaaggaaacttaggcactatagtctacgccaggtacgtggggtgcctttctacactcagactcactcaccacaagtagttctaaatacctgtcttttgccccctttcttctgccttctgaattgtttgatctcagaaaatctgatattgctggggatgaatatacttagcagttaagtaaccagggtttgtagttggtgcatcacggttcactttgtggttgattgcattagtgtgcctagcttaccacccaccactcatgagcagcttgaaagaaatggactatataaagtctttgtcatctttagaacttgaatagcaattgtctggaatttaaaggcaatgagtgcagagacgcagttgttccctgaaatgtggcccactgggagggctcctttgtcagagtcagctgtctcctcaaaagctggaggaagcacctgaccatccccccatcccaaaaaaccccatatacatcatactatgacactaaattgatatcctcctttacttttgatgggggcatgagctggggctccaccaccataaatactgaaaattgaccagagtttgggaatgtgtgtatgtttggggaaagggagagagacaggaagtttagaaggacttttcttgaaatcagttggtaagttgagtcctgttggaaagagttgatcattttgattattcctgtatggcttcttgggcctgagagccaaaagatgaggggaaggagaaaagtggttactgaacaaatttattcctgaaattatattaagaaccactattggtttgctttctctctgttcttctccccagtttccatgtagcaaatgaagggggcatataggtctcatttgattttactacttaggctctttgccattatatctggcttcttcaaagggttgggtgtctctgggcgggatccacacctgcactccttatcgatagaggtggatctatataggtaattgatataagtaacatggaatgctgcagtggttctgaggaggaacttaaagaaaggtttgtggtcttctcatggaatcatttcagtcttgccttataggtatactccctttctacaaagttcttccccacatttttcattgaggaggttcacaacatcctacccaaacctggttctgggtatttttgtcactgaagtcattcataatgcctctccactctcttttcctgttctatattctgctgccaaatgttcttgtgcctggcaaatctttgtttacattttgtcttgctcaaagatgagaactactagcttcttgccaactttcttgtcttcttcctctacctctccctctgtctctgccccatcccgctctcctgcaccctgtgcccaaatctgtttcaagggcctgtgtccaaaatactccattttctaaagtatttgttccttcctggggtttatcttagaggtatattttgattcatcacaatatactatatgtgtagttttttgcattgagctgcattttctgcagctgtggcatgttgtagccttctcatctgctgtgcaatattgaagcaactgaaaagacaaaagacctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggctcatctctaccccataagcctgggaagcaaaggctgcagtgagccatgattgtgccactgcactccagcctgggtgacagcaagaccctgtctcaaaaaaataagcaaataaataaataaatagaaaaaggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacacaagccccattattttgtattccagatttttttgttcactgttaccattctccattagaatccagacaggaatctgtaacaggttttgttttgccagtctagtacaggctgatcatcccaaatccaaaatgctccaaaatttgaacctttttgagtaccaacataacactgaagggaaatgctcactggagcattttcagcctgtactgtataatgcaaatattcaaaaataaaaatctgaaacactcatggtgcccaagcatttcgaatatgaaatatacaacctgtaatatgttttccaaatgtgtccaacatatattttcccccttttttcccattacttcctgggtatctcaccaaaaaagtgaagagtttgaattttcccagaattgtttaccaataagggagagacctcttagcatttgtttcagcctactaatcacttccaagacttccagagatagtttgtcttgtgcctgtgtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataacatgaaatgtatcatcttaaccattttgaagtgtagagttcagtagtgttatgtgtattcatattgatgtgcagccaatctccagaactcttttcatcttgcaaaaatgaaattctgccattgaacttctcatcctcccctctccccagaccttggcaactaccattctattttttgtctctaaatttgactactctaggtaccttatataagtgggatcataaaatattttgtatgtgcgaccggcttttttcacttagcataatgccctcaaggttcaaccattatgtagcatgtgtcataatttccttcccttgtaaggcctaataatattccattgtgtgtatataccacattttgtttatccattcatctgttgattgacacttgggttgctttctccttttggctgttgtgaataataatgatgctgtgaacatggatgtacatgtaactctttgagactctacttttaattctaattttcccacatcctagccaatacttattttctgttttttgataatagccattctggtgggtaggaagtgtatctcattttgtttttcactggcatttccctaatgcatagtgataatgaacatcttttcatgtgcttgttatccatgtatatatcttctttgtagaaatgtctattcaaattcattgttcttttttaatcgtgttatttgttttgttgagttgtaagagttgtgtattcttgtacacgtattaatacctgatactaatttcttctcaggtatatgatttgcatatatttttcctgttctgtgagttgccttttcttggttgtctttggattcacaaacatttttaatcttgataaagttcagcttctctttttttgtttttgttgcctgtgtaaacacctgtgtttttggtgtcgtgtccacaaaaccattgccaaatccgatgttttgcagctttcccactgtggcttcttctaggagttttataacttagctcttatattcaggtctttaatccattttgattagattttttatatggtaaaagtctgtcctttcctattgcatggtcttggtacctttgtcaaaaatcatttgaccatatatatgtgaagatttaattctgggctctctattctattccattggtctttacgtctgtctttatgccagtatcacagttttgatcactgtaactttgtaatagaaatcaaaaagagtgagacctccaaaaatttttccccaacttgttttggctatttggggtcccttaagatttcatataaattttagaagggatttttctatttctgcaaaaccaaaacaaaaaacagcattggaattttgatagtgattgcattaaatctgtgaaactcctttgttagctgggctgcagagtgataagtaattcctgctgaatgagaaatccatttgcttacagacttggaaagatccataattgtgacgtgacttcatttagtttattttgttttactctttgaaatattgaattaaatgctcttcatcacagagaggggaaaatatcctataagatgctgtggaaggatagatagatttatttaaagccataggaaggcacatgatttctcctatctttgcatggcaagtgatggtgttttattgtcagatttttctccagacttgagaggaaatcacaagggtcgtataatccttgggttgtctgataaaaacaaattgcctacctgattcctatctcagaataatcgcttttgttttaagaagaaaagaacagtgtaatagtgactcacttccatgctttggaactttgcctaacattgtttcctatcgagcaaaatttggaattaatcctatagtgtagaatccttgccgtaacagtattcagtttgaccatcataagcttttaagtgttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacaggtaaaaataaccttaggggtgaacatattaatttaaaggcagtgaaatatctagggcatacacctagcagggttactatgcttgaaaggaggtctgcctgaggtagcagctaaaagaacagtccaatttaggatgagatttttttgactgtcaaaaagttgagtgactatataacttattatgtgatgaagtggactttcttgagagcgaaacatgttattacagacaaacatcaattgggtattcatctggccttagtactttctaatctttccaccagtccttataggtctgataatgggatggcataggtaggacattttaccaaagaacatttaaatcaatagtaattaacaaattactaaaaattttctacatatcaaacgtttgacctgtaatccataatccatagttccagaaagaaggcattttgtgtatgtcctcacagttttactacatttattcctcagataattgattctaaagatttatggtatcaacattaaacaaaacagggttcaacagccctgttttatgctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggtctccaaaaaaaaaaaaagaaaaaaaaaagaattggaaagcttgtggggtgctacctcaggaattatagatgctttattacattcagtttaacctgcctgctataggagggatagtgtcagccaagcaaattagagaccatttacaatataagaggtgaattatcagtatatatatatatatatttcttttgctcagcatttctctttttgcagcctaccatctgggtgtgaatttggccaggcagatatgcagaaactggttccaaaggatgagaaggcaggtacgacccagggcggaaaaagatcaggtaactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcctagaaattactgtatcagagggtattaacaaatactttttaatgtggctactagaaaatttaaattatatatgtgtttcatgttatatttctatcgacagtgctgttttataaagaagattgcttttatattatctcatgataaaaattccaaattttggccgggctcggtggctcacgcctgtaatcctagcactttgggaggctgaggcgggtggatcacctgaggtcaggagttcagaccagcctgacgaacatggagaaaccctgtctctactgaaaacacaaaaaattagccgggcgtggtggcacatacctataatcccagctactcgggaggctgaggcaggagaatcgcttgaacctgggaggtggaggttgcagtgagccgaaatcgcgccattgcactccagcctgggcaacaagagcgaaacaccgcctcaggaaaaaaaaaaaaaaaaattccaaatttcagtaagtagaaatcatacacaattttctgactctaatgctacaaacctaaaatgaatacaagcaacttttccagaatgttttttctctggtgttcagtatcaatgaggaaataaaaaaggataaactattaagaaagcaatgaagataattctgtgtataaaaatgcatcaggccaggcacagtggctcacgtctctaatcccaacactttgggaggctgaggcaggtgaatcgtttgagcccaggagttcgagacccgcttgggcaacatgacgaaactctatctctacaaaaaaaatacaaaaattagccggccatggtggtacatgcctgtagtcccagctactagggaggctgaggtgggaggatcgcttgagcccaggaagttgaggctatggtgagccatgagtatacccctgcactcaagcctagatgacagagcgagaccctgtctccaaaaaaaaaaaaaggtatcaggcttaaaacttgtacagaaattactagaaagggaaatttctaaggaactaataaagctgacataggcttagaaccaacaaacaaggacttacatatgacagctggttattgtgagggatgggataacattaataaactataaagaaacctgacaaaatgagaatttcaaatttagtcaaaacatactaaatttaactcagggaaagaataaattgactaagaactgagaatgaaattagattcactgtcaaagaattgcctctctaacagatatattttttctagcaatttaacacatttaacaaaaacgactcagcttctccacagtttttctggaatgttaagagaacaacttggtgacttgttttataagtttgcataaagctcattcttagatctaagagcaagcatataccaaagaaaaagacacatgtcacattcatatacataattcttaaatgctaggaaataaaattgtccagtggtaatctgtgatgtctagtttgaacttaacaagctataacattctagtagggcatccacattgacagcattgggtactgtgcacactgtagtccatgtgaatggtaccccctgggttgggctgtgcctacaacagtcttccaaggtagccctgggttaatactattcatatgctgtcatttgaagatgtcagcattaggtacttagaactccagaggagcatatcagtaaaatatttgggtcgtgtttttgtttttcaaatttaggaagccatgggaattgaaagagtaacaaaaaccataggtaatcttgtcagtacttctcaaggaaccaggtaaatgttggctctacattgtcctattgctcccctcttatacatctgtagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatcttcagagaaaaatatatttactattcattaagaggatcatcatagaggtcttcatctgggtggtcttcacattgagtagctgaggaggaggaaggaagtggggggatgttggtcttgctgtctctgagatagcagaggcagaacaggtcaaggaggtagaaggaaaggcaggtatgcatggtgtaactttgtggaaatacacagtactttctttctgacttggttgctttttcatttctctaaaaatgtgtctgtacaataccaatttttcttccaccgtttgctttagtttcggtgcccatatcatagtaaggtccacatcataaaaagtcaaaagtattctttagtaatcagaaccctctgccagattgtcttatgtcactttggttcctggcactgcttctacatcttcttcctcatcatctggtatcggttcagaagcactcatctctatcaagacgtcttctgttacttgctctggtgtggtgtttattagctcttgaatttcactgagattcatatcctgaaattcttcacccatgaccttttttttgctatatccacaaactcgtgatttccttgattggcgctgtcataaatcctgttaagttctgcacaatatcaggacagttttctccaacaggaatttatttcaggcttgatggctttttctgtgacaatgatggcatcttcagtggtgtaatccttccagactttcgtgatgttccctctgtcagggttctcttccacagcattaacaatcctttccttagagtactgtgtgtaatagccttaaagccccttatgactctctgatctagaggctgaattagagatgtggttttggggggcaagtagaccacttcagtgccttttgtgttgaattcatggggctctgggtcaccagaggcattgtctaatgtcaaaagaactttaaaaggcactcccttactagcaaggtacttctgacttcagagacaaaacatcaatggaaccaatccagaaaaggggtcttgttgcccaggccttcttgtacaaccaaaagaccagcagctggtagtttatctttctccttcaaggctcggaagttaggagctatataggtaagggcagtcctgattataaacccagtagcatttgcacaaaatagaggagtgagtctgtcccttcctgccttaaatccttctgctcacttctattccttactaataaacgtcctttgtggcctttttttttttttccttcaaagtagggcacttttgtctgtatgaaaaaccctttcaggcagataccctttctcaatgatgttcttagtggtgtctgggaacttatctgttgcctgttggttggttgtcagaagctgcttctcctattatcttgacattctttaagccaaatctctttctaaaattatcaaattatcctttactggctttacattctccagctttagatccttcactttccttttgctttaagttttcatatagtgagttcattattttcttgaattgcattagaatctatagatttgtctttattatggcaatcctgtacccacataaacgtgcattttcaatatgaaataaaaagatttcacaaaagtgcaaggttttcaagcctgctggtgtagctgcagcaacagcttcactaatttccttttgtttgttttacaatggtctttacactgaattcatttttcctgaagtggtgggcaatctgcaatccatatcaaataattcaactttttcttgaagtgtcatgacttttccctgcttcttgggagcacttccaacgtcactagtgacacttcatatggggtcatagagtgacccaggtttattccaggttttcagtattgcggtaaacatgaaaaacaatgcgagaaccatgagagatcactacacaatttactggagagatgaactgttcatgtagaagtgcttagcctcacacagtgttttaagcagattgtggcaacacttgagctcaccacagtatcagcaggtcgtggctacaaaattattacagagtataatatgtactaaattttatccagttactcaatactgcttatttactgcaaatggcaccgtgtataagtgtatgtgcataagtgtgataaatattaaatttttataatttgtgtatattttatggtagtaaatgataaaatagactagtatctacatatattttatgcgtttatgacatacctaactttttgttaatttttcaatattttgaggctacatgtttcatctgagagttttttcaaattgtcaccaatctccaaaattttcagtatatctattgaaaaaaaattcacacataagtaggcatctatagttgaaaacctgtgttgatcaagcgtcagctgtactttgattcagacctagcccttcttgtctctggatcatgaaataacgtttcatgaaaaaacgtgaaataacgtttatttttaaaatgctatggcaacattttcatttatgattttaaaagtatatttcattgtagaaatataaaaacacatgaaatatttaaagagaagctggaaagcactcagttttttgtgttttcttttacatatgtttatatttgtatgctgccttttccttgttgaattatatattgaaaagcatcctatgaaatggaaaatttgagatgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgatagggatactcatcctgtattctttagtaggtgggaggtgtcacttcagtgtgtaaattttactcttgccttttacatgaatttcctattgcttctgtctctgctttacagaaggttaaagttttgcctttttttccactttcaggctgacattcttcatctgttcagttggtttcacatccccaatgctgtttgatgagaggaagtatccctaccacctcatgctgcaaaaatttctctgctccggaggccacaatgctctttttgagtaaggatcaagttgcttcacagaggagcatttcttggagtttgatctttgctgtgtgccttcccagcccactgcttttaagtaccctatcttgtaacagtgggatatatagaaatagctattggttgtatccttcagtgttctgggaagtaaccatgtttgtctccatttaccttggagggtaggatttagcctcccctagagttgtgtttgtaagggtctctgctttttctcatgtggcttccagttccaagtatgggtttttaaaataggtttgtctttttctgttgtttctctgaatataatttttctgctattcttggtcagatgatttcaagatgagtttcactggtttaggtttttttgtgttttttttgttttgttttgttttttgttttttttgagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgtaaatagatacttgtgggaaaggtttcagagtactaaagagagaatcattcatggacccccatctaaaacaaatcacaagtaacagtcttgtattttcttttagtgttttttcctgttcatttaagcaattgggataagactgtatagaaagttttatattctttttgttaagtattatgactattttcccatttgctatatacattagtccatcttttgaatgttctctaatttatttaaataattacctatccttggacatttacttccagtgatttcctgttaaaagtaacactttggtgtagccccagtaagacgaaccattaactgtgtttaattattccattttccttgaaagattataaaatttctctgtaaatctaaagctttacaacttcaacatagactgcacaaccttggtgataaaccatttccatattaagcatatacattagtgccaggcactgggtactttatattaatatatataaaacctcaatcatcacaattattctgcaggtaaaaattatttcctctgacccatgaggaaaccaaagcctagaaaatttaacacatcttagattacacaactggtaaatggtaagaggtaaaatttgaactcaaccaattctattattatttacccttatgttcccctcccctatcccatgctaatctttgttactgagtagaaattggtatctggttgttgttgttttttccctttgatctatcaggagttgaagctaccttgtgcttgggtggttgaatcaagtggcatccttaatgtcctaatcaaactcttggaagtggttcagccctgcctccaggcagccaaggagcagaaggaagtccagaccccaaagtgagtaaccctatatctaccctagtttcgtttctatttccctgggacatgggcctgaatcaggcactcttctggggcatgtatggggcaaatttgtggtacttctgtagttttaaaattataaaggaagcatctgatgaaattaagatatattttcccaatttgtgcaggtttcttgctttcccaaaacagatcatttttcttttttaggtggatcacaccagtgttgctcctgattgatttctatgaaaagacagccatctcctcaaaaaggagagcccagatgactaaggtgtgtaatgtagtatgtatgactgcaggacggtttagcttcctgaggcaagagtagaccagaagagaatatgagagagtagtgaagaatatagaagtctctgaccaatgtataaatctcttaagggattttcatagctaggtttctcttctgaataatttactctggaagtaaattttgaaggagtgtgctatctccagaggaggagcggcttttctgttatgtaagggactgagtatacagcaatcctaccaaaaagcaaacactccttagatgaagattattgtgccacatcatctcactaccttcttggaaacagaatttttgtttcagtacatctcaggtgaacattccccttttagggaaaatcagtagaaacaaaaggaaagtagaaaatggcaagataaggggctgtagatagtttttttgtctaggaaaagtatcttagtccgttttgctgttgctataacgtaataccacggactaatttataaaccataggctgggcactgtaggctcacgtctgtaatcccagcactttgggaggctgagacaggtagattacttgagttcaggagttcaagaccagcttgggcaacacatggtgaaaccccatctctccaaaaaatacaaaaattaaccaggcatagtggtgtgtgcctatggtcccagctactcaggtggctgaggtggggagatcacttgagcctgggaggcagaggttgcagtgaaccgagccggcatcgcgtcactgcactccagcctaggtgacagagtcagaccctgtctccaaaaaaaatatttaatataaactgtacaagtttatttggctcatagttctagaggctgatctaagggaccacatctggtgacagccttagtgctgcatccttctattgcagaaggtggaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcctttgtaggagtacctctcgggtgttcagccaagagactattctcaaaacactgtattttggaatataaaagtatagttaaagctttttgaatgtttgtaatctgccaggcactgtgatagacacttaacaaatatccattgtgcagatcagaaaacaggttattatattttaggaaacttacaaaccagtggaagaaatagcaacgtacttataaaaaataaaaacatttgtaaagttaagacaatagtctgggtgtggtggctcatgcctctaatcccagcactttgggaggcaggtaaatcacctgaggttagaagttcaagactaggtgggtgtggtggcatgcacctgtaatcccagctacttgggaggcagaggttgcagtgagccgagatggtgccattgctccccagcctgggtgacagagcgagactctgtctcaaaagaaaaaaaaaaagaagacaacagtggagggttgaggggcaaatgtcctagtagtgaggcttttcctcctcagtacttaatacaaaatcctttcttctgctgattctttgtcatcaataatgactgttaatagactttgcttccgttttcctctcttgggacattgtttcccacatttataagcagtgttgcaatatgcgtttttgtgcctaactttgttcatgtttaagatcgttacttagagatttttagtaattggatcaaaaggcattacaagtattttttaacttgcttgccagaaaagtggtatcagtttttgtatatctgagtatacattttagattcttcagacagttctttacacagcctgcttgatttcacctcacatgtgccaaatcaagagaaagagagctgttaaaggtagcttgtatggtgatccacagtccaggagataacccagcagggaaggaacaactatatacaactaaattctgattttagaaacttgaaatgcttgaaacgctttctataaagaaatgtttaaaagttacaagttcaaagtgctaggagaaagtgtaggtcctcattggatgagggaaaacttttaaagttttaactttaggtaaattatagttggggtgtgggaaacaaaggaacatcagtgacagtcttaacgtatcaagatggcaaaatgtaaagtcttggtactattcattgctagtacaggtgtggaaaaccaggcatactcttaactttcggtaggagtggaaattggtgtagccacatgggagggcaatttggtactcttggtctaagatatcctttgacctagaaattctatggctaagaatttatctgataactaacatcaagtataccaagatgcatatataagagtgttcactgtggaattgcttgtaatatcaagaaactagaggtctaatgtccagcagttgggggctggataaattatggcttatccttaatattgaaattaaacttttctgtgtttattaaatggaaattattttataattacagccagacaggcaagatacagagggtataatgtgctaaagggcatgattgatttggtttaaaaaaaaaaaattaagataccaaaagatgtttttcattgtgagcatgtagtttgtgaaataacagataatggaaaataatacaattgagttattttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatgaaagaaaaaatacaggatcatttcttatagagaaaagtagactagagagataatcaccaccagccttggttgggctgtggatccagataaaagatttggagaaatttgagtgctatgtattaggtaatgtaattgtatctgttaaatttggggggtattataatggtattgcagttctgtataaaaatacccttgatctcccctctgctgacttttttggtaataaaaaagaaaatatatgtccttgatcttaggagctacaagtagatgtatttaggagtagtcacttggtaattctggatgaaaagtatatagatgtttattatactattcgaacttttctgtaggtttgttggatttgtttttttattttattttttttttttaattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttccatccacacagacccggcaaccatccgatttctcaatttcttccccacccttcccgcctttctattccacaaaaccgccattgtcatcatggcccatccccaatgagccactgggcacacctcccagacggggtcgtggccgggcagaggggctccccacttcccagtaggggcggccgggcagaagtgcccctcacctcccggatggggcggctggccgggcggggggctgacccccccaccaccctcccggacggggcggctggccaggcagaggggctcctcacttcccagtaggggcggccgggcagaggcgcccctcacctcctggatagggcggctggccgggcgggggctgaccccccccacctccctcccggacggggcggctggccgggcagaggggtcctcacttcccagtaggggcggccgggcagaggcgcccctcacctcccagacggggcggctggccgggcggagggctgacccccccacctccctcccggacggggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgaccccccacctccctcccggactgggcggctggccgggcggggggctgacccccccccacctccctcccagacggggcggctggccgggcagaggggtcctcacttcccagtaggggcggccgggcagaggcgcccctcacctcccggacggggcggctggccaggcggggggctgatccccccacctccctcccggatggggcggctggccgggcggggggctgactcccccacctccctcccggacggggcggctggccgggcagggggctgaccccccctcccccctcccggacggggcggctggccgggcggggggctgaccccccacctccctcccggactgggcggctggccgggccgggggctgacccccccacctccctcctggacggggcgactggccgggcagaggggctcctcacttcccagtaggggcggccgggcagaggagcccctcacctcccggacggggcggctggccgggcggggggctgacccccccccacctccctcccagacggggtggctgccgggcggagacgctcctcacttcccagacggggtggctgccggacggaggggctcctcacttctcagacggggcggcggccgggcagagacgctcctcacctcccagacagggttgcggcccagcagaggcgctcctcacatcccagacagggcggcggggcagaggtgctccccacatctcagacgatgggcggccgggcagagatgctcctcacttcctagatgggatggcggcggggaagaggcgctcctcccttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcgcctcgggaggccgaggctggcggatcactcgcggttaggagctggagaccagcccggccaacacagcaaaaccccgtctccaccaaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccatggaaggagaccgtggggagagggagggagagggagagggagagggagaggagggagaggagggagagggagtttttttttttttttttttaataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatctcaagccttctatatcatacatgcccccttctgagtctttattagtaacctagtttaggtactgcttcatgattgactggtttttctctctcattttggcttagcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaaggtatgtggctagcctacctcaggaggctgggcactagaggatatgttactttgcctgggtcatttcagccaactcatggcttagtgagcactcactatgtgcccatactctggggctcaagatgaataagatacccattgcatgtctgtgaagaagctaatagtcatatagtatgacataccaggatggtggtaagtccttagggtgaggcaccttacctagtgagggtgcacaggtaagaaaatttctttgtgtacatgatttctaaaatgaaccttgaatggatgagattgccagagttctgttatatgagaatacacaccatacgggggaagaatgaacaaagatttagaaggagataatagcattctgtgagaggttgaaaataagacaccaggaagtctctaatgttttcatactcaagcaaaacctttttattgtctgaagagctggaggcaatattaggaggtgtgtctgagtttcctaactgttgagaccaccacacccatccacctttattcctagttaaggtgcatcttataagcattaggaaagtcatgattgatttgcttggaacataggtttccattatagtaaggtccttctggattttattcaggacatacttatttgataggtccacagaattgccaaaaattgatgaatgctgcctttaataagcaaaagaaatctgagtcttgaccttggtgcttttcatctgtacagaaccctgatccatatagaattccttggttctcctatcaccccagaatctttaccctatctcttatcacctccccgaaatagtttagctatatagctgtggcaaccatttattgacccaccactgcatgagcaatagtgccaggtatgttcacttaaggtttgtagttacagcttaggaaagtgagactaagttaattgcctgtggtcacaagactagtttttgtaattttagggtgaggcactctaacattatctgtaatagcaccatgtaaacagtcatagccacttgatgtgaaattgaccaagactgactagataggccttaacattgtccaattgtagaagaggtttattttgtttttgatggttgttactgttttcctagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatgtaagtcaattccaacagcgttttatctttcttctcatttttcaatgcctgtgtggtctcagtatttagggctatccccggggaatttcaaagatattaattgtgatgtatctgtaaattatctgttgcctgtaaagacaaaattggggtgtccctggagacttttttttctctcctaggattagaactgttctttaattttttttcttttccctttccttccccgcctcccccacagtctcccagtcactgtatttataatagcctcccacagattatagtataaaggtgtaaggtggttaaaaggttggccaaagagaatctgtggcattcccagccagtgccctgggaaggagttctgccatttgcagacgggtgcttttgaaattcataatagctcaggagttttcttcttcttcagagtcaggtctttgctgcagatggtgcctccactgagacttccgcatctgggacctcccaaggagagggtaatgatttgcttttctcactaccatgttcttattccttaggaaaacaacttgaaaaaactgtaggtgtcctgtgcagggggtaggagaatacagacttaattattacgtttactggtctaagtgaactttctcaggtgagctcagtgttctgtaataaagggtctctatatgctaaagttaatggaactgtaagttaaccaacctagtaatggttgctgtggtaacatattttagttttactttttaaatcacaccataattatttggggggtttctaaaaactggcttatagagattttatgccagtgatattgttctagctacatgctttacgtggtggatgcctgtcttccagcaatgttaacagagcccattgactactcaccatgaactagaaaaatgtccctgggagtaagtctaatgagacctttaaagagctgcttctccttagataggaaaggtctttgtgatccaatttaggagacattttgtttaaaatcatactagttcctggagataaatttaaaaggctaacattagtgaaataattggttaactcattttactgggtttactggccatatgtagtgtatagcgtggatgatggtgctgattcaagggaagcattacccactatgtggcagactatattggacaccaaaatggatcagatttgttccctgtacttaaagtactttgtccagtgactgagacctgcaagagttataatgcaggataactgccagaatgaaggcatacttggataagatataatggacatgtaaagtatctcacagtatgtctagatgagacaggaaagcatttatggaggaggtcagcatttgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactctgtctcaaaaaaaacctgaaagagctaggccttttttcattaggttcactgagagagagagttaatgagatttgttctattgaaagtccctttttatgcattgtggagattgaagagggaagactggagtcagagagaacagttaggaatctgatagagtaatctagtaacgtacgatcttggtgaagttggaggaaaatgggtgagttgaagaaatatttttaaggtacaaatggacaagaattgggtttggaagatgaaaaaggaaattaagactcaaggatgtttcttgatttgtgggggtttttttaattgcttttatgggttggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtactcacacatgtgcaaagacaccagatgtggtagcagtattggtaataaaaataaaggaaaagccttaaatgttcattagtagagctgtggaaaagaatgaagtgtcctgatgcagaattatcctcaggttagattttttaagtgagtggggcattttgagaaactgtatcacatgttcccgcatatgtaaaatgggtgcccaaatattttttcccgtaagggtgccttgttttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagcattacaagctccctagaagctgccctccttgttctttagtgcatctcctcccacccatttcaccttcactcaagataaccattatcttgagttctcgtgccgtaatttggttttgtagttcatgtaaatggaatctcatagaatgtactctcttttttgcctggcttcttttgcttaacatacttgattcattttgtgtgcaggtgaagtttattttcatctgtataaaattccactgtggaatgtaccatgtaccaaaacaaatacatcttttacccattctactgctaataaacatttgggtaattttgcctttggagctatcacagatagtgctgctatgagcattcttatgaatatatataagttcgtgaactacccaatttctgttgggtagtatatgcctaagagtaagaattgctgagctctagagtatgatagttgttctgctaatgctaaaagttttccagagtggccaggtcagtttatattattaccagcagcatatgggagatcaacagttggtgttttttcattttactgattttaatgggtttgtagtggtattgcattatagttaaaatttacatttccctgttgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtagctgggacctataggcacatgctaccacgcccagctaattttattttttgaggtcttgctatattgcccaggctggtctcaaacttctggcctcaagtgatcctcccgcctcagcctcccaaaatgctaggattacaggcatgagccatcacacctagccaggctttattccaaagctttaactcatttatgccagttgtattcataatttataatagtattacctgtgggttaacatatttaattacaaatttattaagtatctgcctaatatgtgtccagtgtcctaccagtactgggtactggtaagtgctttataaatactattgttaatcctcacctccacactgcaaggttgttgatagtgatctctttaatagaggagagaaggctcaaagaggtaagtaacttgcctgggaccatactacagagtagcagagctaaaattggaagctagggctatgattccaaagctaagtcctttctacgtggttattgagaaaatagttttaactttgtatgtattcactactgggaaattaattgttatttctaattgttttgttttgacaaggtcactttattcagtttctcagactctcaaattattcaatgcattttctttattgaggtaaaatttatataaagtcaaccattttaaagtgtactgttgagtggcatttagtacattcgcagtgttgtgcaactgtcacctatgtagttccaaaaatgttcagtgtattttcatccaaaatttgcttgaatgacaatagaatttgtttctaagataaggaattgtctaggcaggaattgtagttagagaaaaaagaagagtctgacttaatttccttcctctattgagcctttttcgttactttaaataaccttgcattaaatatttttgcatattagtttctgtgactctgctgtctcttgctcagctcttaccagcttctattgtagcacagggtcctgggcacattgtaggtgtcagtaaataatttcaatttaattgaacactgaagggtttatagcacttaattaagaatcaaggtttgaatcctcagcccttgattaaattcttctgtgcaagccacttctttagggggcttcagattaccgcttatcaaatgagaaaatacttatctatttatagatttgctgtaagtagttctattaaatatcacatgtgaaaatattttaagataggtgcaatagcacatgcctgtagtctcagctacttggaaggctgaggtgtgagaacacacacacaggagtttgagactgtggtgtgcgatgatcatgcctgtgaatagccactgtactctggcctgggcaatatagcaagacctcatcttcttaaaaacattttaataaaaataaagtttttaaaaaatgtttttaaaaatacatgacatctacataacagtgtataagctgtgcagtgggaaatgggtggcatttggaagttttctaaaatctgggtttgctccttacttgcttgtatctttgagccttggcttcttcatctataaagtggacctaataatcactcattgggtgacttaaggaaatactatgtgtgtgtgtatctttggtcctgtgcaaatgatatggcataattgtgcttgtaagtaaatgtcgtgattcatgacttttcaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggtaagattcatacctgtcccagggctaatagccaagaacatccccttattcttcttcttagtccatgggtggttttgcacttgaacaaaacttcttgtcatactggcatcatatactctctggtccgctcaaatagttctggcggttggaaatagccagagcactgattaccattagagtaagtgggtaaacctagagaaaacaaagggaaatgttaagtgtacttttaaggtcttcaaggaagttgagcaggttatttgatcttatattttaaattttatttaaagtaggggctgggcacggtggctcacgtctgtaatcccagcgctttgggaggccaaggccggtggattgcctgagcccaggagtaggagttgaagaccagccttggcaacatggcgaaaccctgtctctacagaaaattagctgggcgtagtggcacgctcccgtagtcccagctactcgggaggctgaggtgggagtgtcacttcagcccaggaaggttgcagtgagccaagattgcgccactgtactccaccctgctacagagtgagaccctgtctaaaaaagagaaaacgaatgctatcaccttagggagtgtgttctcacctgtttgtttagatgttatttccagaaggaaatacaaaagttacaggagggttatctgaggctattttgtgaagacttggcctgagaaatggctatattcatatgatagagatgtcaaaacttctctcccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccaggtaaaatcatgccccagccccaggcttttccttctcttcagcctcactacacgaatgatgtggaggtagctggtgtagtgggaaaactttgggtacaagtgggagacccaagtctttcttattgtggcttttagcacttgtctttcttaaagccttggttcttacttgctataaactcaagagttgaactataatagtgatttttttttcaagcttccccccactttaaaaattaccacttattagaagattatatgtatattataagaaatacagatgagtaaaaataagaagtagacactgtattcctaccacccagataccatgattaccttattggtttattattcagtgtttttctttgcatgcataaataatgtattctttactaacatgatatgatacatgctattgtgttgggggaaatttggggcattttcgtttttattttcagttactggtcacttccttgctatgaaaataagtttcatcctacctaatgcccaaatccataattaagcatttttctccaaaccagaatccaattaaggacttgtattacatctggctatgttttctgaatctctcttattctaaaacaattttttttcattatttcgatctttattttgtttttgttgttcatgattccagcttgttgaagcgaccgtgtttttgccttctaaacttggtgcagttgcttccttgcagtgtagtttaacttaatcctttacttcctgatattttctgtaaacttctagttagatctagaggctttagaggcttattgaagcagtttaaacattttgggctgaaatgtgtagcctaggtgatgtatagctcatattgtatcgtgggagacacatctcccatgataattgtcactttttgttcttactagaaagtcatctctgttgttattttggcactttacaaatgtctacactatcaatcatatacctaaataatagccttaacatcagttgataattcttgcctggatcaattaatttctttgaggcttatgaataaaagctttctaatttctcatttcgaatacattattaactggcatttttctgtgttagcctcacagggaatgtctggttgtgctaaaatataatttctattataaaggcagtataaaaacttaatttctttctatttacatttgagattcaaatgtaggtttttttctggctttctatttttaagtcgtattatggactcgacttttcatgtttgttttgttttgaaactagtgattgaatttatttggatcactgcagtcactttttcatgctcaaattattacacctttgacctatgtggccccttcaagatgactaaattgtccttttgctacaaacctatcaattttttgaaacatttataaatgtcaaactcacagtactgtaatgaacaccatgtgtctacctagattaaccactgctgaacattttgctttatttcttcccttcctgtcctttcaggagctgaatcatttgaaattagttgaaaacactgtaaaactttacctctaagtacttgatcatctgtctcctaagaacaaatattcctttatatgggtacagttccattgtcatatccaaaaaatttaccaataatataataatactaaatttatacaattttatatacacatactcccagttatttcaattatgtctttatactctgagggagagtgttttgatccgggattcagtgagtatcacatgttgcatttggttgtcacattttttttttttatgacattttcctgttttgatgaatccaggcttgatgtcttatagaacatctcacagtctacattgatgtaattgctcccttaatggttagggtcaggttaaacatttttggcaaaaatactacatgggtgatatttgcccttctcacatcacgtcaggagacaggtgaataccacttggtcccaatacttgtgatgctaaatttgatcacagccgaggctggtggatcacttgagcctaggagttcgaggccaacctgggcaacatagtgggaccctgtctctgcaaaaaaatacaataattagctggacatgtacgcctgtagtcccagctttttgggaggctgaggtgggagggtggtttctgttagatttccactttgtaatgaataattccattactatcattattctttctgatactcagctgggcctgtggtaatgatcccattaattttttttccccatttttgttgttatttttcctctttatagaaacaggatctcactatgttgctcaggctaggctcaagcaatcctcccatctcagcctcccacagtgctgggattacaggtgtgagccatcacgcccagctgtcccattaatttttgaaagctttttggcacaatgagatatcccaggcttaccttatcccttccttgccctattcctgggatcacttgttctgacgagtcttggttacttttagtgtgatgtgatatcagagactgccatcttggtactactagtgagcatatatatatatatatatatatatatatatacacacacacacacacatacatacatacatacatacatacatagactcacacataaatacacacataaagcagataaaagcagagctgctctggtgttagtgggcacctggttggtctcacacaccttattacacttagaaatcataccacacctccaactgcagcccctattgtacttttattgaactctaggaagccctacagagtataatttgaaattcacaggacttcaaactgttatcagccgggcgaggagggcaggttgcctgagctcacgagttcgagatcagcatgagcaacatggcgaaaccccatctctacaaaaaatagaaaaattagctgggcatggtggctcacgcctgtagtcccagcgacttggaaacctgaggtgggaggatcacttgagcctgggaggtggaggttacagtgagctgagattgtgccaatgtactccagcctgggtgacacagcgagaccctgtctccaaaaaaaaaaaaggaaaacttttatcatgttccttcctttgagcttttagggtttggggactaaatgctggtggtttaaaaaaaaaaatcctgagtacatccgagaagtggcttgcttgcatgtggtcatccagaatacattctgatttccagtcaagaatttgttactcatgtgctttccatggccccatgaaatatggcattgatttaactcttgcttttagggtgggttccttgaagacatttaagtcaaaattttttttttctaaacaaaagtagagtgttagttgtacgaccttatgccccttttctcttagtagattccattgtaagaagcttagtgtcatttagaagatagacacctagtatttctgtgctcagtccatctctttatcttcccttatctcagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcgggagaacgagtgaatctcttcctcccccatcaccgtgaaacttcccttttagcgtcaagttagaatcgagttcttagaatcaagctgtcttgatagggcaggtcttgacaacttaaatcacaagcatgatgtagcagaaaacactgaactgttctggtctgttttcttggccaattaatctcttacctctttgagcctcagtttgtcacctgtaaatgaaaagttcgagaaaaaaatgggttggattagataactttgaagataacatctatgattattttgcatttttgtgattttcatcagtttcccttagagttgagcctctgtccattcagcaaattgaacaatatttgaggagtgcctactgtatcctaggtactagggatacagcagtaaagaagaaaacagtcctcgttcctcataggagtggtttattaggaatcataactaagcaggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcctggcacgtgggagcttattgacacccacttggtgccaggaactatggaataatatacaacttaagtacaaaaccagggtggtattcagaaaaataacttagacttgtgtgcacatcatcaggtttataatcatgttctgcatttaatagaggatgcatgaagaggatctcatggtaacaggttgcagggcacctctggacttaacagtgatcatggtacccaccattaccctacaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtgagccttccagagctagggcaaacgtgtggagagttgtttccctggttctctgtggctacaagctctgcctcttggcttcctccctgaccccaccagagcagcctttgatttttgcctctttgaaacagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacaggtgattcccaagggctgggaggattcatctttgactgtgtctgccgtaatgtggttttggcatacacatggcaccaggaatcactgaagaatcctagaacgttcacgttgaacctgggaaattttttatttcaaattcaccatacattgacctggtttttaggggaaagaattcaaacctagaggggagatttctcaagtgtcaagggaaaaactggagccagaagcagaatggcttctcactcaacagtcacactgcatagtctctaccgccaaggacagcatcaagacaaggagaaaaaccttatctaagtccatgctcttagtcgcccacttccatttctgtcggtgaactgccagtgtggggaatcttaccgagatgaccccattccgtcatttgagtaagatcagcctaggtgtcagatcagagaaaatgtttgtactctgaaccccatcaccacatgtcattttttctagggctcacatgtataaaatcactaatacaattttggtttagaaggaagttacctacttttttctgaaacttctgggacctcagacagagatcttttaaatgtctgagtaaatgttgatagaattatacattacagtgtatcacttgatataaaagggggaaaaactgatagaaatacaaagaaataagacttgagagtgaaagactttagtataccctactcagcagttaaggaatcaggtagattaaaaataagggtagtgaagtgttcagttaaaataacaaggttgatctaacaaatatctttatatagaactttttacctaatacacacattgtttcaaacttgatataggatgaaaaataagtgaacctagcctgtgactgaaaagactagagtggacaaaataaaaaataagccccatgaagggaaaaaatacatagatgaaaccaagaaattcttgctagaatgatcatgatcgtgcccatccctaaggggtttttattatcctttccttccatatttatttccccctcagccccaaacaattcttgaacctgagtatgtatagagaaattggtcatatatttgcacagtgaaatgatcaccttcctttggtcacatggccaaagcattctccattagatcactgaactcctagatggtctgggtggaggatggtgactattacagttgacctctatcttaggtgcttgcaaagtcccacattggtctatcccttctttttgcagtgtactgcatctaagtcaaatgactccactgaacagaatctctcaggtaactctccttccctttctcccttcttactaatcaattggttgcttctttatcctgatagttccgagtagctggcccacataggctgaagatggacactggtgctctgtgggatgaggtagtagattgtatagttttagggtcataccccatcttggagataactatacagtctactgtctttcccacggtggtacacttcttctccgactggctctgttcaggttcttgttctggttattatctactttgttctggcatgggtaatgaggtcatgtgtcttgttcatttcctgactgcaactctgtcctctgaaacagcatgttcatgtacatctttgaagtggctggtcctttgatgaccaccatggtgtggcacttcatgagaataactgatgacagtggttctcaaatgccagtcctctgtggaaacgaacaaaatcaaggagctttaatgcctttttcataaagctgaatttattccatttaaaaggctgtttttgtatttagagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggaggccgaggtgggtggattgctagagcttaggagtttgagaccagcctgggcaacatggcaagaccctgtctctactaaatatacaaaaaattagtcaggtatggtggcacatgcctatagtctcagctacttgggaggctgaggtgggaagatcacctgagcccgggaggtgaaggctgcagtgagccatgattgtgccactacactccagcctgggcaacagtgagaccctgtctccaaaaaaaacaaatagagttttgaacgaaattctgaccatttcttgctccaaatagatgaagtgggaggatcaataggattttggtagttagattttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtctgactttaaagattactctctccttccacagttcccaggatggcaagcatgtcatcccacacttagagctctcccattctcctggcagacactgtttatctcatgacactatttctcactggtttgaaatggggcctgaaaagtcttctcagcagtatttcaacaggataaattgatacctgcttgccatccctgctctataccatcttgcttgtgaagttctctggagagaccctaaggtgtcagttttttctttcaaggaaccttgtttattttattttattttattttatttatttattttttgagaaaaagtctcgctctgtcacccaggctgcagtgcagtggtgtggtcttggctcactgcaacctccgccacccaggttggagtgattgtcctgcctcagcctcccaagtaactgggactacaggtgcacgccaccatgcccagctgatttttgtatttttagtaaagatgaggttttgccatgttggccaggcttatctggaactcctgacctcaggtgatccacccgcctcggcctcccaaagtgcttggattacaggcatgagccactgcgccctaccgaaaccttgtttatttagagaactacagggatatgcacgtgcaagtggtgcctgcagtgaatcaaagtgaaaaaatcccttacccgggctgggcgcggtggctcacacctgtaatccaagcactttgggaggccgaggcaggtggatcatgaggtcaggaattcaagatcagcctggccaagatggtgaaaccccatctctactaaaaatacaaaaaactggccgggcgtggtagcaggtgcctgtaatcccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacagttccatttagatggagggcatgtatgtgggaggactgacaataagcgggggtgctggtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtaagtaacagtgcatgcagtctagcaaataacaaaagctgttctgagcccagggaaggtggggtgggccttctctgtgtcccatgtcttgcaagcagtgaagacatatacactggtttccctcaaggagtgacatgggtttattttctccaagtacatattaggcaccaatagaggtgtgagaggctgggcgcggtggctcgtgcctgtaatcctgaaaatttgggaagcagaggtcagaggatcacctgaagccaagagtttaagaccagcctgggcaacatagggagaccccatctctacaaaaatatatatgtaaattagccaggcattttggtgcatgcctgtaatcccagctactcaagatgctgaggcaggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtcta

SEQ ID NO: 915 - DNA, 43812 bp, mus musculus
cgcgacatttgccggtcgcccggcttgcactgcggcgtttcccgcgcgggctacctcagttctcgggcgtacggcgcggcctgtcctactgccgccggcgccgcggccgtcatggggttcctgaaactgattgagattgagaactttaagtcgtacaagggtcgacagattatcggaccatttcagaggttcaccgccatcattggacccaatggctctggtgagataaacctggccgcggccctgcgcacgtcccggcctggaccccttatccggtgccggagtagtacaacccagcccatgtaacctgaaacgtcgcggaccttacgggttccttgcccgtccagagggggttctgctcgaacccactctccccgcgcgggtgctctaactcgaaccccttccaggtgtcacttgccgcttcctgcgcggcccccgccccggcccagtggtacaggccgagctgccagttaccccgcctacttccccctcccgccaaaggagtcgcgtctggaaccagcttcccgccagctcagtcctccgccgcgcggctccccgccggaccggccggagccggcttcccagccttacttgaccccctccggagaatgtggggacgctggtagctctcccgtggccttcggtcccaaacggtgcacttctgtttcagcccagcgtcctctctcgcctcgcattggtacactccaactcctttctactcttctctggaggcggcacttttgaatttcagacccagcgctccagtctttagaatgcttgaggtgtcgatccccaccccccaccgctatgtcagaggtagttgcctcgaactcgcccttttcctaccaccgaaaccgtcaaaagccgaaattaactaatttaccaaatttgttgaatgcttattgtttatcaggagttattcagttgcaagttgtggaaacagcggagaatagaataaaccaactccatgctcacagggaacttatattccagaggggaaagaagataaggagaaaataagatggttttaggctgtcataagtgctatacaggaaatgagacaggtggatgtgataaagtgacttaggtggtgtctttagaaagggtggtcaggtaaagcctctattttgtgtcttcccaactctaaacgatacaccgtggattcctctcacctcagatgtccatttggaatcctgctgtattcttccaccccagagatgttctagctgaatgatatcctagcctaagaggctgcccttgctgaagtagcacatactgagtacctttcctggagactgagtgtctcaacagtggcactattgacatttccagcgagataatcctttgctgtgggatgtgctctgtgcattgtaggatgtttaacagcatctctggcatctacctgctagataacagtagcacccctgctccccaggcatgacaatcaaaactgtctctagacattgctagatgtcacagagggtgtgtgtgattcccccaaccccccaacttgtttgagaaccactggcctggagggctaatgcttggtgtccacccagtttcctcgggttttagtgtagtggcccctgttggaagagctaggatgtacctcttggcattcagtcccctcagcattagtagatttgtattcccagctgttctgaaaagggctatggcactcccccacttgcccccgttcttcaaggcccacctctacaagccattcctttagtccctttggtgagtgagtcttcctctgtggcataccgtagacacttggtacacgttaatgtttattaagtcctatattgatggtgcatgtttttgtatcttcattggcctgtgagtaccctaaagcagacattccttgaaacgttttactggtgttcagtccataatatatattacaaaaatgtttaccatattgattgtgattagagaggcttggggttgtgagatgatgttgtcctccctggaaatgatgggagaagcccaaaggttggatattggttcctaaaaggctgactcctggtctgcatgatgtgctagtcctgctgtgatgagggagacagctgagtccagacttaggataggactaattaattgagtacctactctgtgtgtcaagtactttatttattgggaccctgttttttctttttctttttcttttctttttttttttttttgagacagtcttgctctgttgtccaggctggagtgcagtggcatgatgttggctcactgcaacctctgcctcttgggttcaagtgattctcgtgcctcagcctcccaagtagctgggactacaggcgtgcgccaccccatctggctagttcttgtatttttagtagagttggtgtttctcccagttggccaggctggtctcaaactcctgggctcaagtgatctgcctgcctcagcctcccaaagtgctgggattacaggcatgagccactgcacccagccaagggaccctttacaattaaattctcaaaatgaccctaggaggaaaatgccaatagcttcgttttatacatgaggagactaaggcacagaggtgtgataacttgtccgtggttctcagaacccatgcctgtgctcctgccactccaatagagaagtatgtgccgcacatatttttagacccgtgagttgtggtttttttcatctttttccaggtgagggaatggaaggtcagctaagtggtagtgaaagtaagattagaacctggtctgttggttctaagcccaagtttgcaagcttttttagatggagtctcactctgacgcccacactggagtgcagtggcatgacctcggctcactgcaacttctgcctgctgggttcaagtgattcttttcttttttttcttttttttttttttgagatgaagtctttctctgtcgcccaggctggagtgcagtggcgtgatctcagctcactgcaacctctgcctcccgggttcaagctattctcctgcctcagcctcctgaggagctgggattacaggcgtgcaccactatgcccggccagtttttgtatttttagtagagacggggtttcaccacgttgttcaggctggtctcaaactcctgaccccgtgatctgcccacctgggcctcccaaagtgctgcgattacaggtgtgagccaccgcgcctggcctattttttttttttttggagtcagggtcttgctctgtcaccaaggctggcatacagtggcacaatcatggctcactgcagcctcaacttctcgggctcaagcaaccctcccatctcagccttcccagtagtcaggacaactggagtgtgccaccatgccgagccaatttttgtattttttgtagagatgggattttgccatgttgtccaggctggtctcaaactcccgaggtcaagtgatccacccacgtctgcttcccagagtgctgggattacaggcgtgagatgccgtgtccaacctaatcatagtcttataccgtctctatggaaggacttgggctgctgtttttatggctgagtagaaaggtgttggaaatcagatcttcagttcaaagtcatatataagttctttagggacagtcttgagatagaaattatagagactaaactgttcctccttatccaccagcccgactaaacttttttttttttttttttttttttgagacagagtctctctctgtcgcccaggttggagtgcagtggcgcgatctcagctcactgtaacctccacctcctgggtttaagcgattctcgtgcctcagcctcccgagtagctgggattataggcacacaaccgtgcctggctaatttttgtatttttagtagggacggggtttcaccatgttggccaggctggtctcaaactcctgacctcaggtgatccgcctgcctcggcctttcaaagtgctgggattacagtcatgagccactgcacccggcctaaacttttaaaacaatatctattttttggccaggaacggtggctcatgcctgtaaccccagcactttgggagtccaaggtggaggatctctggagctcaggagtttgagaccagcctaggcaacatagggagaccctgcttctgcaaaaatccaaaaactagctgggcatggtggcttatgcccatgcttcccgctacttgtgaggctgagacacgaggatcacttgagccaaggaggtcagcgctgcagagagctgtgatactgctactgcactccagcctgggttacagagtcagactctgtctcagtatgtaaatgaataaggtctgggagtggtagcttatgcctgtaatcccagcactttaggagaccgaggtgtgtggatcacttgaggtcaggaattcgagaccagcctggctcacatgatgaaaccccaactctactaaaaatacaaaaattaactaggtgtggtggcacacgcttgtcgtcccagctattcaggagactgaggcaggagaatcacttgaacttggtaggtgcaatctagcgtgggcgatagagcgagactccatctcaaaaaataaataaaataagtaaatgaaaccttttttgttttcggattctaaaatgaacaaagtaaaagctgtaactccactactgaaaagatagccactgttaatgttgaaaaccttatttatttgaatagctggtacatgtacatggtatacaattttaaaaatccttaaggatatacagtagtaaaaagaagactcccttgaccctagctgcttagtttccttttcagaggcaatcactgctgcactgtttacgttttcatatatttgtttcctatgccttctcttctcccaagttttattatgaaaatttgcaagcatatatgtgcattacttagtcatttggaagtaaattacagactcaattacatttcacccctaagtgcttcagcattcacctcttaaaatcatcattctcctgtactaccactattcagttatcacaactaagaaaatttcctcatgtcatcaattatccagtttatatttaagcttccttaacttgctccccaaatgtctttttgttattttggaaccagagtccagtcaaagtttgtgcactgtttacctatgtctcagaaatctctcatgttttggaatggttcgctcactttttttttttttttttttttgagatggagttttgctcttgttgcccaggctggagtgcaatggcgtgatcttggctcaccgcaacctttgcctcccaggttcaagcgagtctcctgcctcagcctcctgagtagctgggattacaggcatgtgccaccatgcccagctaattttgtatttttagtagagacgaggtttctccatgttagtcaggctggtctggaactccccaacctcaggtgatccgcccgcctcggccacccaaagtgctgggataacaggcgtgagccaccgtgcccggctcaccctttctttttagacactgactttttgaaaagaccaggccatttgtctttgagaacatcccacattctgtgtttgtgttaagatttcctcatgaaaaccttactatgttcctctatattgtattgctgtatttcctaggaactggaagataagtctgaaggcttgtttagattcagattaggctggatatggtggctcatgcctgtaatcccagcactttgggaggccacggcgggaggatcacttgaggccaggagttcaagactagcctgggcaacacagcgagaccttgtctttattataacaaaaaattaaaaaaaggaaaaaaatagattcaggttaaatatttttggtaagatacatcataaatgatgctgtgtgtttcatattgtttcacaacaggaatatgcactttttttagatggtggtaaaatacacataaaatttcctaaattaaccatttttaagtgtgcagttcagtagtgttaaatatattcacgtttttgtgcaaacgatctctagaactttttcatcttgcaaaaatgaaaatctatgcccattaaaaaacaactcccaggccaggcgtggtggctcatgcctgtaatcccagcactttgggaggccgaggtgggcgaatcacaaggtcagaagatcgagaccatcctggccaacatggtgaaaccctgtctctactaaaaatacagaaagttagctgggtgtggtgatgtgtgcctgtaatcccagctattcgggaggctgaggtgggagaatcccttgaaccagggagtcggaggttgtggtgagctgagatcacgccactgcactccagcctggcaacagagcaagactccatctcaaaagaaaaaaaaacctcccattttcccctcctcccagcctatttttaaattttactttacattattattattattattattttattttattttattttttttttttgagatggagtcttactctgttgcccaggctggagtgcagtggcacgatcttggctcactgcagcctccacctcccaggttcaagcgattctcctgcctcagccttccaagtagctgggattacaggcgcccgccaccacgcccagctaagttttgtattttttagtagagacagggtttcaccatattggtcaggctggtcttgaactcctgacctcaggtgatccacctgcctcagcctcccaaagtgctgggattacaggcgtgagccaccatgcccggcccactttatattattttaacatcgttgagttttgtgtcttgtttgtttcacctattgtgggcttttgtccatgtcattaaaggttgtaaaactatccattctgtgaatataccatttctttagattgggttctagcttctttttttaaactattctttcctctttttttttttttttcactattttttttaaagagagtcttgttctgtcacccaggctggagtgcagtggtgtcatcatagctcatgcagctttgaactcttgagctcaagcgatcctccctcctcagccttctgagtagctgagactacaggcgcatgccactatgcccagctaattttttttttttttttttgagatggagtctcgctctgtcgcccaggctagagtgcagtggcacgatctcggctcactgcaacctccgcctcccaggttcaaggaattctcctgcctcagcctcccgagtagctcatgcccagctaatttttaaagtttttgtagagactgggttttgccttgttgtccaagctggtttcaaactcctggcctcaagcgatcttcctgcctcggcatcccaaagtgctgggattacaggtgtgagtcactacgcttatcctgggttctagcttctggctgctatatagtaactgcaaaaggactgtttttcctaagcctttgacccagaggtttggttgtgctcagtctttatggggacagaggagtagtctctcttcccattagtctgagtactgagtgattaggggacatttttgttcatctcaatatctttattccttttcctctcctcttcatcctgactttccctctactgcctcgtccctcttcccttaggtaagtcaaatctcatggatgccatcagctttgtgctaggtgaaaaaaccagcaacctgcgggtaaagaccctgcgggacctgatccatggagctcctgtgggcaagccagctgccaaccgggcctttgtcagcatggtctactctgaggagggtgctgaggaccgtacctttgcccgtgtcattgtaggtgggtgaggctggccagaaagctctccttgggtcctgggaggtggctagactagttgattgggacaggaaggaggcctgacccttgccaactcatgcattgtcttgtaggaggttcttctgagtacaagatcaacaacaaagtggtccaactacatgagtacagtgaggaattagagaagttgggcattctcatcaaagctcgtaacttcctcgttttccaggtgggcgtttttaacagttattggctatctggtttttgccagaccatgtcccatccccactctgtctgctccatctcaggctttatcatctctcccttgaactaatgtagcaccttgttcactgagcttcccaacttcagtctggcccctgagccaggttcatcttatgaggacacacatttgttttgtttcccctcccttttttccttaaaacatttcagtgattccgtattgccttacaatggtggttcttaaactgtagtctccagaccagcagtatcagcattacctggtaacatgttagaaaatgcacattctcaggccctatcctagacttcctgacttggaagaaactgtggagtggggcacagcagtttgtgttttaccaagctctccagtttattatgatgtcggccgaaatttgagaactattgccttaggatgagatccaaactcctaagcctatcatttaggaaacaccatcatcaaaatccaaataccatctgcatgttcttctccagccttgcactccagcctacttaaaccatttatggttctgcaaattcacctgctttctttggcctacaggtctttgcatattacttttcctcttcatagaataactttttctctgttttttttgtttgtttgttttttgttcttgtttttttttttttttttgagacggagtttcgcttgtcacctaggctggagtgcagtggcacgaccttggctcactgcaacctccgtctccagggttcaagtgattctcctgcctcagcctcccaagtagctgggactacaggcgcccgccgccatgcctggctaatttttgtattttgggtagagatggagttttaccattttggctaggctggtcttgaactcctgatctcaggtgatctgcctgcctcagcctcccaaagtgctgggattacaggtgtgagccaccgcgcccggccaccttttttcttttattttcttggttagtttccctccagcttccaaactcagcacagatgtcacctttgggaagccttctgagatagatatccctatcagtctcctacccccaagcttcattttgtccttttcctatgctgcttctgttactgcacataacactttgttgtctttgtccctttggctccctgtgctcctcagagggcaaggaatttgtcctcaaagcccagtgtgaaatgtggcagcaggggcatgggagagaaagttggtaactttttctgggtgaaggagtggaaatgggtaaggtgaactgggttggctggggtctgaagtggaagagtgtttcgacctttactagggtgctgtggaatctattgccatgaagaaccccaaagagaggacagctctatttgaagagattagtcgttctggggagctggcgcaggagtatgacaagcgaaagaaggaaatggtgaaggctgaagaggacacacagtttaattaccatcgcaagaaaaatattgcggctgaacgcaaggaagcaaagcaggagaaagaagaggtaggtggccaagctacctcttggctctgagggaccaggatggagccagtgccttatcgatgcacccctgccaccattcccctgtttgcacaggctgaccggtaccagcgcctgaaggatgaggtagtacgggctcaggtacagctgcagctctttaagctttaccataatgaagtggaaattgagaagctcaacaaggaactggcctcaaagaacaaggagatcgagaaggacaagaagcgtatggacaaggtggaggatgaactgaaggagaagaagaaggagctgggcaaaatgatgcgggagcagcagcagattgagaaggagatcaagtaagaggcagacctgggcctgcaacttgtgggaaaccaagaggccgtgctgtttattagggttcctctgagcccggagttcagtacctatactcatttctctgttattctcctaacttgcttttgtaagaaccaggcacatttcttgacttgcagtttagacaaatagaatatttaagcactcaggccctgggtagacaggtgctcagatgagggagaactcaaaaggggtggtggccttgccaagaaagaggaaccaatgtgaggccgagccaatggagtggctgagaaggccttcctagaagaggaaactgaagctagaagtttaaaggataggaatttgaggggccaactaagtaaatacaggatgttcttgggagttgttaatgagcttcctggccagggttgaggcagagttggtagctttgccttatggagtggctggaatgccaggctgaagtcatacctttcagggagtagtcagactgcccctttttttcaggatctgtggggcattacgcccatgttcttttaagtaattccctgaggttggctcaggggctcaagctctcctttgggtgaaaagcctgggaaccctcccttcttccatagttctcactggtttcccccacccctctggcaaaagggagaaggactcagaattgaaccagaagcggcctcagtacatcaaagccaaggagaacacctcccacaaaatcaagaagctggaagcagccaagaagtctctgcagaatgctcagaagcactacaagaagcgtaaaggtgacatggatgagctggagaaggagatgctgtcagtggagaaggctcggcaggagtttgaagaacggatggaagaagagagtcagagtcagggcagagatttgacgttggaggagaatcaggtaagctctggaaggggttggcagggaggagatccctgggctgacatctgctgacttggtcatccctgttctccttccctgtccctaacacaggtgaagaaataccaccggttgaaagaagaagccagcaagagagcagctaccctggcccaggagctggagaaattcaatcgagaccagaaagctgaccaggaccgtctggatctggaagaacggaagaaagtagagacagaggtgggctatagttataagattagggatgatggtccacagaaaaggatatatataggttgagcatcccaaatccaaaataatccaaaatctgaaacgtttccggtcctaagcattttggattagagttacccaacctgtaatgatagtctttttttttgtttttttgtttttttgagacagagtttcgctcttgcccaggctggagtgcagtgatgtgatctcagctcaccacaacctttgcctcccgggttcaagcaattctcctgcctcagcctcctgagtagctgggactacaggcgtgcgccaccatgtccaactaatttttgtatttttagtagagacagggtttcactacgttggccaggctggtctcgagctcctgaccttgtgatccacccacttcggcctcccaaagtgctgggattacaggcttgagccactgcgcctggccatgataatcttaatgataatgacaatgataatgacagtagctcacatctgttgagcacttactgtatgataggcaatgttctttacatgtatccactcatttaattcttcatttattattatctttatggaatggctactattaccctattttatgaatgaggaaattacaacacagagtaatttgcctaaggtcacaagattattgttatttttgagacagagtctttctctgtcatgcaggctgaggtgcagtggtgcgaccatggctcactgcagcttcgacttcccaggcttaagcaatcttccaaccagagcctcctgagtatccagcattacttgtgcttgccaccatgcctggctacttttttttttttttttttttttttttttttttttttttgagacaaagcctcactctgttgcccaggctggagtgcagtggcatgatctcagctcactgcaacctctgcctgtcgggttcaagtgattctttttatttttttatttttatttttattgttttttgagacgcagtttctctcttgttgcccaggctggagtgcaatggtgccatctcggctcactacaacctctgtctcccaagttcaagcaattctcctgcctcagcctccccaagtagctgagattacaggcaccagccaccattcccggctaatttttgtatttttagtggagacggggtttcaccttgttggtcaggctggtctcgaactcctgacctcaggtgatccacccgccttggcctcctaaagtgctgggattacaggtgtgagccaacgcacccagcccggttccagtgattcttgtgtctcagccacccgtgtaggtgggatgacaggtgggtgccaccacacctggctaaattttttgtagttttagtagagatgggatttcaccatgttgaccaggctggtcttgaacttccgaactcaagtgatccgcccgcctcggcctcctaattttttaatttttatagagtcagggtttctgcttgttgcccaggctggtcttaaactcctgcctgcctctgcgatcagcctgccttggcctcccaaagtgttgggattacaggcgcgagccaccgtgcccggccactcacataactattaagtatcagaaccagaccctgggcattgtagctctaaagcccacactcttaccaaatatactttacttactgcctccctgatatcaatattgtaataacagcaatgatagaaagttgtcatagtgtcccaggagtgtacagtgttcaggcattctgctaagcacttttaaatatttaaaagaatgttggccaggcgtggtggatcacttgaggccaggagtttgagatcagcctgagcaacacagtgagaccctgtctcaaattttaaaaaataataaaaattttttaaaaataatgtgatagtcattaatattaataacaaccctatattaagcacttaatgtgtattctatgcagtggagattacccacattttgcagatgaggaaacaggtacagaaaggcctgtgaagctttatcttgatttgagcctccatggttggtgaagaagatgccttggctgggtagaacacctatgagaggttctggagctctgggaggcccccatcattagttagtagatcaaaccgaacaccatctatgtctgctttttagtaggcctcctatattagtgacagattgtcctggactgttcggctcttggatgagtgggcacataaagggtgtgatctagagcccccatggtcttggcgtaaactcgtgcagcccctgatgatggaatgtttgtttcccaggccaagatcaagcaaaagctgcgggaaattgaagagaatcagaagcggattgagaaactggaggaatacatcaccactagcaagtatgtagctctgcatctgtcccccttacttccaggcctgttcttgtgaccctacctacatgcccctcttcatgcaggacccccagagctctctgagccaggagtattttctcaccagccggagtaactcctgtgtgccctcactttgtaggcagtccctagaagagcagaagaagctagagggggagctgacagaggaggtggagatggccaagcggcgtattgatgaaatcaataaggagctgaaccaggtgatggagcagctaggggatgcccgcatcgaccgccaggagagcagccgccagcagcgaaaggcagagataatggaaagcatcaagcgcctttaccctggctctgtggtaagagcagagagggaactcatttcctgagcacttacactcactgtcacacgattttcccagcagccctgtaaggacagggttgccaatcccatttttattgttgggggaaatgaggctcggagaggtttaaaaaagcaccgcttctaagaggaagaactgcagttcaaacccaacttgttctcctgagctcatgttctttttttttttttttttttttatttttcaacctgtcatactaggcaatcatgttcttttcatcataccaattgcgtctttctgaaggttttgtcttgctatgtctatgcctctgggaggggaattggaaaaccaggaaagattttggaagcaggtggggccatggggctggaattactctcccaggaagtagctctgtgcagtcttataaaggggctcccttggcatgtattaactggtccagtagcttttagggacaccctgagctttatcagatctcttgatcttttggcctctttcaccaaatcctgagttcccaggttccctgaatattatcccatacctgggttcaacttagtttggttccactaatatttccctatcacttctctagacactgctggggagataagtatggttagagtcagtccctgcccccttaatctgatagttcttagggaaccaggcttggttttggaggctgcaggaagggaactggtagaagagattgattgattgattgattgattttgagatggagtctcgctctgtcgcccaggctggagtgcagtggcacaacctcggctcactgcaatctctgcctcctaggctcaagtgattctcctgcctcagcctcccaagtagctgagattacaggtgctcgccgccatgcccaactaatttttttgtatttttagtagagacggggtttcaccatgttggccaggctggttttaaactcctgacctcaagtgatctgcccgcctcggcctcccaaagtggtagggttacaggcgtgagtcaccacgcccagccagatttattttgctaagtgcttgtgagaatttgaaataatatatataagatacttggcatagtgcctgggtggtggtggtctgtaaaatggtagatgtgaggtttagaaagatgattctggattcagacacgactgcctgaagtcattgcttgggaaccagaataggcttttccttgatagcatgggggctgtgttcttctgtgagataggaaaaaaccaaagtgttttttctactctcacaaccagcacaacacttcacttctgacaccagaagtgtgggggtttttcctcacacaccaagcaattctccagcagacaccagctgggtgacctataattcacttcagctctgacactatttatctggagatagcatcagatcctgtgggttaggggctcagtccaagacttcaggtgccaattgcaagtctcaggttgtgacttgtggttctgactgacctgctataaattacagttcccgagaatccctccctgggttcgattaatttactagtgcagctcacagaactcaggaaaatgttttacttatgtttacccatttattatgaaggatattacaaaggatacagagaacagccagatggatgcataaggcaaggtatgggagaagagatgtgaagcttccatgcccaatctgggcaagccaccctccaggtacccccacacaggggcttcattatgtagtcatgattgatcagatcatcagccatcggtgatcagttcaaccttcagcccctctcccctcctgaaggttgtaggggtggagctaagagtcccaaatctaatcctgccttggtctttctggtaaccagcccctatccagaagctatctatgggcctccagccataatcatctcattaacatacaaaagacactgctcattcctgagattctaagggttttaggagttgtgtgtcaggaactcacgggtagaagactaaatatatatttcataaaaccacagtccactttgatcttcaaacacagatcccttacatcagaacaatcatgtaataaatagaaagatgctgggagcggtagctcacgcctgtaatcctcgcactttgggaggccgaggcgggcagatcatcggaggtcaggggtttgagatcagcctggccaacatggtgaaaccccgtctctactaaaaatacaaaaattagccgggcatggtggcgggcacctgtaatcccagctactcgggaggctaaggcaggagaatcacttgaacctgggaggtggaggttgcagtgagccaagattgcgccactgcacttcagcgtgggcaacagagtgagactccgtctccaaaaaagagtagaaagatactggcacattactagaatcccactgagtcattaattaataattagtctagtccatgatcatgtcatgtaaaaatgtctcctagggtgaggccattcaggtttgcaggcttctattcaatcttgttaggttccaaaaccaggagtgttctcggcaaacatagcttcatactttcaggcatctgggataattgtgctaagagacaatatcatctcttgctctgaacctcttttgaggtgttaatgtaatactgagtttccctcattacataactcatttattcatttctttacctcccttctcttacccaaacttttccacctttcaaagggacgttaggattggccactgtgctgatctggagtgcacacagcaagctagtctgcaattgcctcctcctcagtccatacagtctcattcagatagggtagggttgcatgggtacagaactagtgggctgtcttttttgtttgttttgagacagggtctcattatgttgcccaggctggtcttgaactcctgggcttaagctgtcctcccattgcaacctcccaagtagctaggattacaaacacacactaccatgcttggtattgggttatcttaaccactaggcaatacagttgcattcacttcctgatatagattctagtctgtccccctttccatactgggaattaggattcctgagccagcttccaaaagcttcatacttcagttttcccttcctactttactcagtacggccgcctcattgacctatgccagcccacacaaaagaagtatcagattgctgtaaccaaggttttgggcaagaacatggatgccattattgtggactcggagaagacaggccgggactgtattcagtatatcaaggagcagcgtggggagcctgagaccttcttgcctcttgactacctggaggtgaggcttgttggggattgggtcaggccagtgttcaagggcccctcctctagtactccctgtttgtgttctgccactgactgagcttctccccacaggtgaagcctacagatgagaaactccgggagctgaagggggccaagctagtgattgatgtgattcgctatgagccacctcatatcaaaaaggccctgcagtatgcttgtggcaatgcccttgtctgtgacaacgtggaagatgcccgccgcattgcctttggaggccaccagcgccacaaggtgtggattcccttgcccaggctggagctggacaggctcagtactggagattcatttgttcagcttctccccctcttctctcttccccctgctgtgtgtagacagtggcactggatggaaccctattccagaagtcaggagtgatctctggtggggccagtgacctgaaggccaaggcacggcgctgggatgagaaagcagtagacaagttgaaagagaagaaggagcgcttgacagaggagctgaaagtaagccacaggcagtgctgtttttagcagtgggagtcctaagcctaggtcagccaccaccttaccacctagcccttctttcttgttcccttcaggagcagatgaaggcaaaacggaaagaggcagagctgcgtcaggtgcagtctcaggcccatggactgcagatgcggctcaagtactcccagagtgacctagaacagaccaagacacgacatctagccctgaatctgcaggtggggcctggccttcagccctgttctccaaaggccatccacacattcctggcctaggtttctctgggggtggggaacttgtttcacttccccgtctcctcccagcctgccgcagggagtcaggtatagcatagagtcagacagccaggggttcagagcttggctctgccttgagtatgacattaggcaagtattttcacctctcagtgtcaaccttcacatctttatctgtgaaatgcgagttaagatgatacctactcggccgggcacggtggatcacctgtggatcacctgaggtcaggagttggagaccagcctggccaaacctgtctctactacaaatacaaaaaattagctgggcgtggtggcaggcgcctgtaatcccagctacttgggaggctgaggcaggagaattgcttgaacccgggaggtggaggttgcagtgagccgagatcatgccattgtactccagcctgggtgacagagcgagactctgtctcaaaataaataaatgatacctactttatagggtcattattgaatgagttaacatgtaaagtgcttaagactaccatgtgttcagtttatgttatgtgctattgttagcataatttattcattcaacaaatttgaatttttgaaagtgagctatgggcatttcagtccctgcttgtggtagtgggcggggcggggggggactgttctaggtatattaatgtgttttgttttttttactgactacttccccagaccgccctagaggttttatatgtagtgtgtgtatttatatatctttttctaaactcaaaaaatctaaactgaattctgaaacaactctgcccccaggggttgtagatcaaagactgggacctatacctaatgatgtttactgtgtccccagccctgtggattgaagctggctgaactggatgccagggaagaagccatgtgatggcttcagtgcaacatcatggaggcttgactagggcagtagtgctaagccaggttctctcagttgtggagagctagcccttcctgactgtggggccaatgcagtcaaggtagctttttctccaaggagcctggtctgctttgtcctctcaacccattgcctgtaggaaaaatccaagctggagagtgagctagccaactttgggcctcgcattaatgatatcaagaggatcattcagagccgagagagggaaatgaaagacttgaaggagaagatgaaccaggttggtagggtgtgggccatgccagcgtgtgtgtcagggcaggactgggactggaagcaggacagactaaaagggccgatgccctccctggcttctcttctcaggtagaggatgaggtgtttgaagagttttgtcgggagattggtgtgcgcaacatccgggagtttgaggaagaaaaggtgaaacggcagaatgaaatcgccaagaagcggtaggtgggaggattggtagaagagattggcatgcccttgagcctctagcttgacatccttggaaaaccagatgctgtcataggcaagggtcagctcttagaactatgtgagtttatgtagctaggccttaaagaacagaaatcaggagggcagtatggcatagttatagtggttaagagtgccaactctaaacttgattttctggattcctggattacaaccccagctccacaactcgttatctttggcagtgacttgacttctgtaagctgcaatatctgcaaaatggtataatgatacctatctcatggcattgttgggaggattaggtgaaataattttttttttttaagattacctgttttaccttttttttttttttttttttttttgacacaggatctcactctgtttccgagactggagtgcagtgtcaatcttgaccttcccaggctcaggtggtcctcccacctcagcctcctgagtagctaggactacagatgtttgccaccacgcccggctaatttttctttttttgttttttgttgttgttgttattgtagagatggggttttgccacattgcccaggctcgtcttgatctcctgggctcaagtgatcctcctgcctcagcctcccaaagtgctaggattataggtgtgagccatattgccggcccttttttttttttttttttttttttttttgagacagagtcttgctctgtcgcccaggctggagtgcagtggcatgatctcggctcactgcattctccaccttccgggctcccgtgttcatgcaattctcctgccttagcctcctgagtagctgggactataagtgcacgccaccatgcccggctaatttttcgtattagtagagatggggtttcaccatgctggccagactgatctcgaactcctgacctcgtgatccacccgccttggcctcccaaagtgctgggattacaggatgagccaccacgcctggccccaacccccgcctggcttttttttttttttaacctttttaaaaggtatttagcagcttacatatcatctactaagagcaagaaatagtagcttttgttgttattatcataatgggcaacgtgaggtggagggaggcgggagatgaaattcttggttgaaacaatagtcagaagaaaataatcttctcatttttcctcactttagttgattcattcattcaacaaacctttgttgagtacctaccttgtgccaggttgtcttgtgctaggtattggaagggggacaagggagatggaggtaagacagatgaacacaacacagtctttgctgaaggaggtcatcccttgtaccctgggcttcagttagcagtttagccctttgcccatacagtaaatattcattgctgtcctacttcaagccagtctcaagggatatagaattgaatcagactgtatttctttcctcaggaaacatatagagtactgggggaaacatcaatttgaggacagtgtgatcaatggtgtaattaaggtagatacaaaatactgaagaaattttcaaggaactgcaaatcaacaacaggaaaaataaaaaacaatgacaagaaacccaatggaaatgtggctaagtacttatgatacccaatgcaatgaaaaaagtaaaaaaaaaaaaagtggcaaataatatagataggctttcatggaaagagaagttcaagtggctaatgaccataggaattgaggtctaacctcttaatcagagaaatgcaaatttaaaagtctgacagtattaggtggaaatctatagatgtcctgtgtagtatgtgaaaaaaatatatgtgtatatatataatgtatatatatacacatatataaaacctatgggtatatatccctgagagagtcttgccatagggtcccaaagagatacacattcagtgtcattcatcttggcataacttgtagtagtgggacattggtggcaatgtagatggccattactgggggagcataagtcaaatgaatatatagactggaatactgtgtgggagttcacagcaagaactagatttgtgggcagtaatggataacttataaacctggtattgaccagaaaaaagaataaaatttataacacagtagatttgtgtaaattttagaactaagacattttacaaggatatgcatttttaaggaatgcatgtgtgtatgtcactttgtggtgcatgttcacagtagggaaggtaatgggaatggaaattggggattgaaacaaagaggacaagggaagggtcttgcccaggcagtggtgataagtgtgttatgaactgtgggatatgattaacttgcttctgcacctaaagtctaaaaagggaggaacccaacaaagtgtaatagaaactaggaacctgctcagaaccgtcaggaaaggttttacaaaacagggagtgatgactggagacctgaagagtgagtaggatttagccagccaggcagcgacagaaaaagtgaattccaagcagagagaacagcatgcttggaagtgtgagagagcatgccttgttctggatactaagtagtttttaatgtctggagcataaaagcagggtcaggaagaaggtggggagtggtggagaggtcagcaggggccggatcacagaggcctttgtgagtcatacttaggagattggatataaaattgcatagctcaaaattatagagttagttatatttcatttggattatagtggctaataggtttaagctgctagcatgacatctggcaacatctgtcacaccatattgggagttggagagggcaattggaagttagtcctgcctggcctgccagtgcctgtgtatgctggttgcatactcttgagtttctgaagagatggagaggaggacaatagcaggaatccagtattttctccatgtttttgtactatccaagttctgccctttaagaggttctgggaccttggggcagaagttgggatgctgtagttgaagcccttggacaaaagtaagctgagtacagtcaatatacctggtgataatggtaactaaaattgattgagtagttatcgtggactcggtgtggttctaaggactttatacatattaactcatttaaaaatctcccaataaccctgaggtaggtactattattatgttcattttgcagatggggaaacaggtctggagagtataaccaacttgcctgaatgacattactagtaagtggcagagttgagatgccagtcttcttaatccactacattatgttgcagtggtggtatactagaaagagcccgggttttggtgttaaatctgggtttcagtctcacatgtgccatttactagctgtgtggccttgggcaaggtcttttacctcttggcctaagttttcctcatttgtaaaattaggataataatgcctacttgcagagctgttgattagaggattagagataatgtatgtaaagtacatagaagcctaataggaattaccatagctggtagaatcagatggactcttttatgcctccttgtaggaacttggagggcgctggggtcttcattgtttaaagggggataaataaggtttggccgaatcttccctgccttatgccatgtccacagggctaggctgaggaacttagttcttcagcttcaggggaccgttttatgtgcatatggatggatgaagcaagttgtgactgaaaatcagtaactctgggtccctgagccctgggtctagtttccctttcttcccatagttggattttgtacattggttatctctggctgatgagattatgagtgattctccccccacctttatacacagtttggagtttgagaatcagaagactcgcttgggcattcagttggattttgaaaagaaccaactgaaggaggaccaagataaagtacacatgtgggagcagacagtgaaaaaagatgaaaatgagatagaaaagctcaaaaaggtaaggaaggaaagaattaaaagacagactaataactgggaggaaaaatgggaagaaatacgacagacagaaggataatgtccacaacttagaaatttctcatctaaatcaataagaaaaataccaagacctaaacgggaaaaatggataaatgtcacaaacagttcaagaagactttcaaatagtccctaaacacatacaaataatttagtcttactaaagaaatgcaaattaaagcaacaattagatacaatgtattttgtaacacatcgtggaaaatgtaaaaacagaagacacaatgctcaataccagccatggtataggagaccagtattctttttttctttttttgagatggagtcttgctctgttgcccaggctggagtgcagtggcactatcttagctcactgcaacctccgcctcccgggttcatgccattctcctgcctcagcctcccaagcagctgggactacaggtgcctgccaccacgcccagctaatttttgtatttttagtagagacggggtttcaccatattggccaggctggtctcgaactcctgacctcatgatccacctgcctcggcctcccaaagtgctgggattacaagcatgagccaccgtgcctggccaggagacgagtattcttatgtaatgtggcaccatccttcaagaagcttcacaatgcatttatactctgtaactcagtagtacctgaggagatcatccaaaatgctggcaaagctttatgcaaacactttgatgtttataacaagcattatttatagttccaaattggaaactactcagtgccccttggaaagtgggaatttagcaaatcatgctacgtttgtaacattatttatgtagtgtcttcaaactttagtaatacacagaccctttttaaaggaaaaatagtccctaagattgccagtgttgccttaaatccgtgatgttacttaagtatatataaatatatatacttagaacacttaaccaaatgctaagacaaagttaaaaattaaatactaacaaaatgagcaaaatttagattgaccatgtaaattcagtgcaacaaatgatgatgttttgctgaaacctagtcacttcacagtgtgactgtgctactgactgctacagctcagttcttttgagtttagcatgcctgtgccaccatgtattgtgtgatgactcaattttctcacaccctttctctttaaactactatgaagcctttgttccttacagcattccctcctgaggtgatttggccttctcttggtttgaacttattgtttgacttatgtctgcctatgtttgtcgcttgtttctgtgttttcatcattaacccctgatgattaaagtagtcctctttagtgtctgaaatcttttttttttttttttttttgagactcagttttgatcttgtttcctaggctagagtgcaatagtacttggctcactgcagcctctgccttccaggttcaagcgataactcctgcctctgcctcctgagtagctggaattacaggcacccgccatcacgcctggctaattttttgtattttagtagagatggggtttcacaatgttcgccaggctggtctggaactcctggcctcaagtgatccgcccgcctctgcctcccaaagtgctgggattacaggtgtgagccaccacgcccggcctggtgtctgaaatcttaaatgcagttgtagcttgggcagtaaaatcctgaggcaagacaagttagatacctagatgatttgggatattacatatatgtaatttttttactttttattttgaaataattttcaactttgcaaaaaattgcaaggaatagtacaaagaactcctatctacccatcaccaagattcatcggtcatcaacatgttgccgcattatcttttgcattctctctctatatatatgcttattattttttatgagccatttgggagtaagttgcagatatgtcccctttatgtgattattatttttttttttgagacaaggtctcgccctgtcgccctgtttagagtgcagaggcacgatctcagctgactgcaacctccgcctcccaggctcaaatgatcctcccgcctcaacctctcaagtagctgggaccacaggcgtgtgccaccacacccagctaatttttgtattctttgtagagacggggttttgccttattgtccaggctggtctcgaactcctgggctcaagcaatctgcccaccttggcttcccaaagtgctggaatcacaagtgtaagccactccaccaggccccctttatgtgacttaagatcaaaatgaaaacaaaaattttcctttgtaaaaatcagaacattatacataaggctataatcccctttggctgaccactcttcatcctagtccccttcgtcttgccagaggtgattcttccagaccctttaaggatttacttaaatacttgtacatttacatatgtgtattcatagaaaatgcacagtattgtttgtgtgggtttaaaaaaaaaaaaacaacaacaaatgttaccatactgcacatgacaaagttttgatgtagaaaaaaatgctcaaatataacattaagtcagaatacagagttttaattacagtctagtctcaactatgtaaaactgtctgtaaatcaaatgctgaaagaaaatgtgctagaatgttaattgattatctagctgatgagattgtgagtgattccccacttaatactttctctatacttttctacatatattagataacttgtaaaattggggtgtgtgggagaggacaaccaaattttaaaaagataggaggctgaggggtgatgggggtgtgaaagcaaagctcattgacgagtgactccaataaactgcctagtaggaagggtgggagcaggagaatatcccagggtaagatggggaaagtcttcacctattgtcctgttcccactgctgggaccaggaggaacaaagacacatgaagatcatagatgagaccatggctcagctacaagacctgaagaatcagcatctggccaagaagtcggaagtgaatgacaagaatcatgagatggaggagattcgtaagaaactcgggggcgccaacaagtgagtgggttcaggcctggggtgggaggacgtagatagagcaggcagcctgccagatttgggtctcacctagcccctggaccttttttagggaaatgacccatttacagaaggaggtgacagccattgagaccaagcttgaacagaagcgcagtgaccgtcacaacttgctacaggcctgtaagatgcaggacattaagttgccactgtcaaaaggcaccatggatgatattagtcaggaagaggtgagtattgtggctggtggtgggagtgggcgatgaacatcattaaccagggatggggagtgaaagtgaccaggaagggcagtgagagagagaaagatggtgggcagatggtgaagggacatgaaaagggatgcagcagaaatgaggcaaggtgcagtggtgaaggcaggtgaggcgaaaggtaataatggctttggtgtgagagagaagttgaattgggagtaaagctgcaagccagtgagtgggtggtgagagagttgagccaggaaagaatgaagtaattcattaaccttagggacctgagctatattagctccagcaggtgacagaaattggtaggagtgggaattgagggacattagccaagagcaaaggaagacagaaagctaggggacctgagggtgatagcttagctgcagtgaggaagattggccaggagagggttaggtaagggacatcagcaatgcagaggtgaggaagtttagttataggaaaaccagagatactagccaaagaggagcagtggaagcaaagatttgtagcaaggggatgggaaatgttaactgagaggaggtttgcatatattaatatcttgtcttagacctggttatatatctcagtcccatgtatctttctccctcctcactttccaaatggcatttcagtttaattcagtaaaatattttgaataccagaaatgttctgggcatcatggtagcatgtgacataattaccccaatcctaaccacagacctgccagacaggcattatccccacattacaggtgaagagactcaggatctgagaatgtgacttgcccaaaatcacaatgttagtaagtgtagacctcaaattttttttatttatttttatttttattttttgagacagagtcttgttttgtcacccaggctgaagtgcagtggcgtgatcttggctcactgcagcctccgcctcccagtttcaagtgattcttgtgcctcagtctcccatgtagctgggattacaggcatgcaccaccactcctggctaatttttgtgtttttagtagagacagagtttcattatgttggccaggctggtctcaaactcctgacctgaagtgattcacctgccttggcctcccaaagtgctgggattataggcgcaagccactgcacctggccatagagctcaattttgaacttgagtcattctgcctgcaaagcctctgttccttctgccatggtgctttctagcaaggtgctttctcaaagattgaaggctgcaaaggagctccctatagaggtgcactctcatggccagtctgctccacttgactctccgttgccattgcagggtagctcccagggggaggactcagtgagtggttcacagagaatttccagtatctatgcacgagaggccctcattgagattgactacggtgatctgtgtgaggatctgaaggtgaggatcaaccacaggggtgtggtgggggtgggggttgggtgggagtgggactatcttcctagttgtccagagaggaggtcagcccatctgggggctctgtgaagaccatggctggaaagaggggaaagctggcaagggtgggaggattcagttgtgaggcaggatctccacctcatatattcaaacagacatatgcacattccctaccccataccccaagttgcccctgcccttgcctgctatcagtcttccccttccatgtgtgtatataactaagctaagcctaggtccacacagagaagagacttcagtacagtgaacagattgacctcaggtgttcctcagggctctttcctcctcacttggcattctttcatcctggatatcactttacttccgtggcttccgctgcaatctctatgctaggtcccacaggtacctcaagccctagccttcctccccatatttacccatctcctcagtgccactcacatgctcagccagaaatttgagcctcatccttgacttctccctctttcactttacataatcaattaattaccaagcaccaagccctatggattctgcctcctaaatatcttttttttttttttttttttttgagacggagtttcactcttgttgcccaggctggagtgcagtggcatgatctcgactcactgctgcaacctctgcctcccaggttcaagcgattctcctgcctcagcctcccaagtagctgagattacaggtgcccgccatcatgcccagctaatttttagtagaggcggggttctaccatgttggtcaggctggtcttgaactcctgacctcaggtgatctgcctaccttggcctcccaaagtgctgagattacaggtgtgagccactgtgcccggccctaaatatctattgaattctggtttttgtttccactgtctaatgcaggccactttcatctcacatagccaactacaggagcctcctaaatagtttatgatgtgtttcaatcatcattatattcaggaggatttgatttttttaacttatggaaaatttcaagcatatggaagtaaagagaatgataataatgaacctcaggcactcagcttcaacagttaagcaatcttattttttataccccccattggagtattttaaagaaaactagacattactccatccgtaattacctcagcatgtatctctagaatatgagaacttttaagaaaaacaaccataatattatatctgaaaatatttaacaataactccacaatatcatctaatcagtaaatgtttagatttccatgaaagtcccataatatttttttatttttattttttttgcagtttatgtgtttagatcaatattccagtaaggtccatatgttaaaattggtctctgctagtctataacattttcttcttcgtttttattttatttttttccttcgtatttatctatggaaggaactgggtcgttggtactatagaattgtctgcattctagatttggctgattatgtccccttgatgttactgaacatgttttttctattccttgtatttcctataaactggtaggtaaatctagggtttgattggattcaagttctttttttggcaagaatatatcataggtgatgttgtgtacttgtgaacttccttctacatcacatcagtagacacctgatgtcagttctcactttctttgtaatgttaacattgaccagtgttcaacattagctatgaagtattcttgccaaaaaacaaacgtggatctgatcaagcttctatatccaatcctcctgaatatgatgattgaaacacatcataaactatttaggaggctcctgtagttggctatgtgagacgaaagtgtcctgcattagagacagtggaaacaaaaaccagaattcaatagatatttagggccgggcacagtggctcatgcctgtaatctcagcactttgggaacactatcagaaacactggtgccagaggaatgttaaaaaagcacttgagggtcaggcgcggtggctcacgcctgtaatcccagcactttgagaggctgaggcaggtggatcacctgaagtcaggagtttgagactagcctggccaacatggtgaaaccccgtctctactaaaaatacaaaaattagccgggcatggtggtgcatacctgtaatcccagctactcagaaggctgaggcagaatcgcctgaacccaggaggctgaggttgcagtgagctgagattgtgccattgcactccaacctgggtgacaagagcaaaactccgtctcaaaaaaaaatgcacagggatgtagttaaccaaatccagactgggaaatttgtttttttgttttttgttttttttttttgagacagtctcgctctgtcacccaggctggagtgcagtggcgtggtctcggctcactgcaagctctgcctcccaggttcactcgattctccttcctcagcctcccacgtagctgggactatgggcacctgccaccacgcccggctaaatttttttgtatttttagtagagacggggtttcaccgtgttattcaggattgtctcgatctcctgacctcatgatctgcccacctcagcctcccaaagtgctgggattacaggcgtgagccactgtgcccggccgtggaaattgttaatatttttaagtgtaatagtggtattactattttttttaagtccttatcttttataggagtggttctcattgagagggtagatattttgttcccccaggggacatatgacaatggctggagatactcttgtcacgcctacttgtcgtaactggggtaggggggttactactggcatctagtgggtagacaccagggatgctgctaaacatcctactgtgctcaggacaatccctacagcaacgaattacctgacccaaaatgtcaatagttcaagaccctgtctcaaaaaataaaaaaataaataaatgttggccaggtgtggtgactcatgcctgtaatcccagcactttgggagtccaaggcaggaggattgcttgagcccaagagctaatttttaaaaattagctgggtgtgatggcatgtacctgtagtcccagctactcaggaggctgaggcaggaagatcgcttgatcctgggaggttgaggctgcactgaacctagatcacaccagtgcgctgtagcctgggtgacagggagaacctgtctcaaaaaagaaacttcaatgtttagatgtcttttatgtttcaatctgttggagtcatttttcttcttcttctctttttttttttttttttaacgtggagacaaggtctcactgtgttgcctaggatggtctcgaacttctggcctcaagtgatcctcctgtttcagcctcctgaagtgttgggattacaggtgtgagcctctgcacctggcccatttttctttgtttttgtttgagacggagtctcactctgtcacccaggctggagttcaggggcatgatctcagctcactgcagcctcttgcctcctgggttcaagtgattctcctatctcagcgtcctgagtagctgggattacaggcatgcgccaccatgcccagataattttttttatttttagtagagacggggttctgccatgttggccaggctggtcttgaactcctgacctcatgtgatccccctgccttggcctcctaaagtgctaggattacaggcatgagccaccacacctggccccatttttcttctttttttttttttttctttttctttttttttttttttttttttttgagacggagtctggagttcagtggcgtgatctcagctcactgcaagctctgcctcccgggttcacgtcattctcctgcctcaagctcccaagtagctgggactacaggcacccaccatcgcgtccagctaattttttgtatttttagtagagacggggtttcatcatgttagccaggatggtatcgatctcctgacctcgtaacccacccgcctcagcctcccaaagtgctgggattacaggtgtgagccaccgcgcctggcccccatttttcttcttgatgctcacattgttcatccttggccagtgggaaccacttcaagtttatttttttgttgttatttttagatttttattatggaaaattttatatgcaaaagtaaaatactacagtgctccctcatatagccatcaccagttttaacaacagtcagctgctggccaaacttgtttaatgtgcacccccacacagttcttttttttttttgagatagagtctcacactgtggcctgggctggtgtgcagtggcacaagcttggctcactgcaacctctgcctcccaggttcaagcgattctcttgcctcagccccccaagtagctgggattacaggcgcccaccacctcgcctggctaatttttttgtatttttattagagacgggatttcactgtgttggccaagctgttctcgaactcctgacctcgtgatcctcccgccttggcctcccaaagtgctgggattacaggtgtgagccatggggcccggcccccccgccccctgacactttattatccctccctatccctaggttattttaaagcaaattctgggccgggtgcggtggctcacgcctgtaatcccagcactgtgggaggccgaggcaggcggatcatgaggtcaggagattgatcctggctaacacggtgaaaccccgtctctactaaaaatacaaaaaattagctggccgtggtggcacgtgcctgtagtcccagctacttgagaggctgaggcaggagaatcacttgaacccaggagtcagaggttgccgtgagccaagatcacgccattgcactccagcctgggtaacagagcaagactccgtctcaaaaaaaaaaaaaaaaaaaaaaaaagaaattctggacatcatatttcatttgcaaatattgcaggatacatctctgaaagagataggaattcttaaaaataattagaaccattacatatctaaaaataatttttttttttgagacagagtctcgtactatcacgggctggtgtgcaggggcacaatctcagctctctgcaacctccgcctccctggttcaagcgattctcctgcctcagcctcctgagtagctaggattacaggtgcccgccaccatgcccggctaattgtttgtatttttagtagagatggggtttcactatattggccaggctggtcttgaactcctgactttgtgatccgcccgcctcggcctcctgaagtgttgggattacaggcgtgagccaccacgcttggcagtaatttcttaataattagtgttacacatccatgatggtcacacgcaaacacacactctacagcttacctgcttgaattggaagtcaaataagatgattgatcaatagttagtggatgattgataaagccattaattgatatgtcacttgaatctcatttaacttataggatccccctccacctgtttttatttttctttgcactatttttttgttgttgtagaaattgactcatttcttctgaaggattgttcacattctatactttactgattgtgtcctgcagtgtttaaaatgttcccttcacccccccgaccaaaaaaaaaaaaaacaaaaatggttctgctatcctctgtagttcttgtaagtgggtagttagatgtagatcagtgctgttcggaagaggtaaaatgtgatccacatatgtaatttttttttttttttttttttttgagatggagtcttgctctgtcgcccaggctggagtgcagtggcgcgatcttggctcactgcaacctccgccccccaggttcatgccattctcctgcctcagcctcccaagtaactgggactacaggcgcccgccaccacgcccggctaattttttttgtatttttagtagacggggtttcaccgtgttagccaggatggtctcgatatcctgaccttgtgatccacccgcctcggcctcccagagtgctcggattacaggtgtgagccaccgtgcctggccaattttcgattttctagtagccacattttaaaaataaaaaggcaaaggtgaaattaattttaatactatattatgtttagcctagtgtcctcaggagtatgatttcaatgtgtgaactatataaaaattattgatgagatatttgatgatccttttttgtactgtcttcaaaatctagtatgtattttaacacagcacgtctcaattcagatgctaaaatttcctcagaaatacttgatctgtatttagatttcctaaaatttacaattgaaaaaggagacccacatacccaagttgttccaaatatccatcaaagttttccagtaactgaattgaatatcaggttttcaatttaaatgaactaaaatttcataaaattaagattttatctcctcagttgcactagccaaatatcacgtgctaagtagccacatgtggctactggcaaccggattggacagcacagtggcttggttagattcagattttggggttcgcttgtttgttgtggctacggctccttcacagctggtggtgttacttccatcagaaggtacttaatgtccattagtggctctttttgtgtggtttgcagccatgcttcttattgcatagatccattaattagtcaggggttgcaaaatggtgaccttactctatcatttctgtgtttactggctggaatactataaagagagacttcctctcatcatttatttggttattctgagatacagtttgtataggaaaggcaggctatatatgcttgatttttttcccccctttatcagtttataaaataaggaattgcttccttggctttctcaagatttgtccactgagttctcatatcattatgaatttaaatatatttggtgtctttcagtctgttgtggttattatccttcttggtgctcaggttgtcccatctttggccaatggtgactcattcagtttggcttctgaatcatttcaacacaaccctggtagtctttgatatctcccttgctttccaatatgtccagattcatcctccccattttccacccagacctggaatccactatttctccaggaagctctgacttcctttagtgggaaatgctattatttagcaactaccatctggatattggagtgttcatgattgctgagtttattagtgcttctagaacttttcaatagattgggctattaaatgcggtttttttgttgaaggaaaaatgcatcatgagttcatattgatactttgaattgaaattgtaatttttagtttaacgtcattgattttctttttgagtcttccagttattgttgctgaaaatctcagttcctagcaacactaacataataacacatttactttatcctactctgtatatactagtttgaaaaatcacaataagatattattagtaaaagggccaggcgcagtggctcacgcctgtaatcccagcactttgggaggccgaggtgggtggatcacaaggtcaggagatggagaccatcctggctaacatggtgaaacgccatctctactaagaatacaaaaaattagccgggcgtggtggcaggcgcctgtagtcctagctactcgggaggctgaggcagaagaatggtgtgaacctgggaggcagaggttgcagtgagctgaggtcgcaccgctgcactccagcctgggcgacagaacaagactccgtctcaaaaaatatatatattattagtaacaatttgattattgaatgtaattttaaatagtttaagattttctgagattctttttattattaagctaaggaaagcctcattgggaatgtatagtcatgttcctatgttttaaagtaatttgaaagaattatctgagtgtctaaccagcttaatatatagttaggtttctttgttttagtttgtttttcatttttagggattactctttttagcattttgattttttttccagctttaattttgagatgtttcaagcctatggaaaacttgaaagactagaatagtgaacactcatatgcctttcaccttagattcaccagtgaatattttaccacatttgctttttctctcatctttcccctgtctttcccctccttccctcttgcctcccattacttgcagtttttttgtttttgctgaaccttttgaaggaagtgtggtcgtgatacttcagccctaaatacttcagcatactaagagcaagggattgtcttacctaatcgtaatttcatattatacctaagaaaatgaataattaggtttcataatatttaatcttcaacccatatttgaatttctctagatgttctaaaagtgtcttttgtagttttttttctttttgaaactagtatccaatcaaaatttatgaatgtcttttatttattatgtctctttagtttcttttaatatggagctatccctttaccttttattcatggcattgatcttttaaagagtctatgagagttttcttggaaaatgtcccacattatggatatgttcttttttttttacaatattatttaacctgttcttccaacccttgtatctcctgtaaattggaaatttcatccagtctggaggctcaatggattcatgttaagtattttttggcaagaacatttcattggtgaacttgatgtggcatccctccaggaggtacatcatgtcaggatgtacccactattagtgatactgagtttgatccctcagttaaagtgtcagttgctaggtttttcaacgctaaatgtacacttttacctttgtcattaattagtaatctttagagtgatgctttggcatcttatgaatatcttgttccccaacaattttttacccagtggttttcacattttgatttaattttgctttaatagttatatataacatctttatgtgtttctaaaatcaaaagtataaaacaaggtacatgaagagaattcttgcttccattcctgtccccttcacctctctttctcgatagataaccctttaattagtttttggattattctttttcttgccgttatatgtttaaaatagaaatatatttgtattccctctaccttcacttcaataaaatatagatacactattgtgtagctttcatattttacttaaaaatctatcctggggccgggcgcggtggctcacacctgtaatcccaagcactttgggaggcctaggcgggcggatcacgaggtcaggaggtcaagaccatcctggctaacacggtgaaaccccgtctctactaaaaatacaaaaaaaaaattagccgggcatggtggcgggttcctgtagtcccagctattcgggaggctgaggcaggagaatggcgtgaaactgggaggcggaggttgcagtgagcctagagcgcgccactgcactccagcttgggcgacagaggaagactccgtctcaaaaaaaaaaacttaaaaaaaaaaaaaaaaacctattctggagaccactccaaagtagtgtatagagatcttcataagggctttctaaaatgtacataagtttatgtccttcttattcttgaaatcattcactggtacctcacctttctcaggataaagtctaaaccttataaggccctttataatctggcttctacttgtctatctagcatcttctctttctgtgccctccaacacacttgtacgcatgcacatacacacacaattgctactactgccatatatatatatatattttttttagctttcgaagtttattgaagttgattactcttttttttttgagacaaggtcttgcactgtcatccaggttggagtgcagtggcaccatcatggttcactgcagcctcgatctcctgtgcctaaacagtcttctcacgttagcctcccaaggagctgggaccacaggcatgtgccaccacgtctggctaatttttttatttttgtagagacggagtctccctattttgcccaggctggtctcaaattcctattctcaagtgattttcctgacaggctcccaaaatgctgggattaaaggcatgagccaccattcctggcttgctttctcttttgaattattttcagtttgatgaacggaccatgagcaacctcccctggctatttttttgtgatgctcccaactgcatagaagtctgttcctggccgggcatggtggctcacacttgtaatcccagcacttagggaggctgagatgggtggatcagttgagctcaggaatttgaggccaacctgggcaacatggtgaaactctgtctctacaaaaaatacaaaaattagccaggcatggttgtgcgtgtccgtagtcccagctacttgggaggctgaggtgggaggatcacttgagcctgggaagtggagcttgcaatgaccagagatcatgccattgcactccagcttgggtaatagagcgagactctgtctccaaaaaaaaaaaaaaaagtctaaaaaggtctattcgttttctctgtcttcacttgttcatcctgtagtccttagcttaaacatattcctggaagcctaccttaatttttatcacccgatgaggtaaccatccagaacacctcaatgcaggcacatattctatacactagtgggatccctccctctacttattatacttatttatacccaaaataccctaggctcactaaacataatagtactaacattcaccactcaagaactatcaatctcctgatctctgagttaggagtctgagtcctcctgagtctgagttaggtgtctttcttgtgtgctaagtcaacactgcctgcttatcattgttttcacattcatcctacagtattctggttgtttacttatgtgcattcctctgttagacccctgagctctgtgagcacagaaaccagggctcacaggacaggatggccccagtgtctggcacttggtaggcattcaataaatatttattgactgaaagtggcagaaaggcacaagcccagacatgcattgcaatatccataagaactaaaactaaactctaatggaatttgctcaaatgtagtgatctaagcagaaaacgtgaattgccttacttattgtggagctgtaagtggagtccaaagcggccagtgtgggagcctccaggtcaccctgggttggtactggctcatggcctgggctgagagccagagaggggcaccaccagctgctcctcctgagagacaaagcggttggcagggcctgggggaagggctagagattagaaagcagctagagattagaaagcagcctcagcctataatttccagagatggtgggaatggttactatgggtaggatctggtggaaggaaccgagctggagaagaagaacctgccctccgtataggagcaggcgcccaggccacactcagtcagtcatctttcggtgggggccttggcacaggggccaggcccttcttgacattgctgggcctggggcttacaggatgcccaggctgaggaagagatcaagcaagagatgaacacactgcagcagaagctgaatgagcagcagagtgtgcttcagcgtattgccgcccccaacatgaaggccatggaaaagctggaaagtgtccgagacaagttccaggagacctcagatggtaagatttacccttctacttgggcctacgatgaggacaagaggctaagggtatgccacgggcctgctatacatcacagcagttcctgttctgacatgttttcttacttaaaactctcaggagccctaaacagtaggggttattacacctgctttatagaacggaaaattgctgaggttcccggagagtaaatgacctgttcaaggtcacacagctggttgctggtagaacacagggaggaatccatatttgtgtggctccaggcccctgtttcttgctctgcattgtatccagtggccagtccactggatacagatccttctgggaccctcctcaggcattcctctctctcagtgggatgttcctgctctggattgtcatttgcaggtccttcttgccagggcactgaggggtctcctgtctttctttctggcagagtttgaagcagcccgaaagcgagcaaagaaggccaagcaggcattcgaacagatcaagaaggagcgctttgaccgcttcaatgcttgttttgaatctgtggctaccaacattgatgagatctataaggccctgtcccgcaatagcagtgcccaggtaggctggagccccttacccaaccagctgctaccatcctcagttgtccttccctctaggcttcctgtccctatctccatccagtctcagatacagatcctgacccatctgccttcccctaggcattcctgggccctgagaaccctgaagagccctacttggatggcatcaactacaactgtgtggctcctgggaaacgcttccggcctatggacaacttgtcaggcggggagaagacagtggcagctctggccctgctctttgccatccacaggtaaggctgatcccctagggcagttgacgaagagactgaactgaggccaccagaggctctggggcccaaggatacacagagatctgcgaaggtgatggtttggtggaatctggattgcatccctgtttcactatctactgcagcatatctggctttggtttttctggacctgtcttccccatccaccctcatctgctcagcatgtcctcaccggcctctgcatgtatttagttccgcctccaggcttttgctcacgaggttgctggctaataatccctttccatgtaaatctagcttgatcatcacctttcaccccttcacccttcctcattctcctcccctttaggaagccctccttgatcactgtggcataccctgaccttcccctcctgaatgccagtagtacttgagtctgactcccgcagcttatattgcttgattgtacagcatcaatttcttgagtgctgctctgtaccagaccctgcggagggattagggacacagatgtatcagacagggtctctggcctcgaggagctcacagtctagtagaagccagatgcataaacagacatgtgctaagtgttgtaaccgggtgagcatgggtgcgatggatacacagaggaggtacacttaacccagtctgtggggagggtatgggtaggccagggaagacttttaatgacaggtgccacttgagcaggagatgtaaaggatgagtagaagtgtgccaggtagaccagcaggcattctaggctgagggtgcagcatgtgcagaggcaaggaggcatgacaaagcatgctgtgatggcatgtgttggaatggggtggacctctaggtagctcggtcattacaactagaaccttggacagctttagctccccagccagcctggaagctcctgaggggaccatgtcttcttgtggttctgtaggaacctggaacacagggctgattgcagaggggagggctttgttgatgtcttggctttcaggggctcaggcaactttgagacctgggttttttagtttctgaagaagtggagtgggaagctggcctgtttgatgggccctggggctgtcccaccccgccttgccaccccctccccgcctcagtgtcagctcacctactggttccctcccagctacaagccagcccccttcttcgtcctggatgagattgatgctgccttggataacaccaacattggcaaggtgggtgcaaagaaagtggggcctgggagggatgcccccaggtcggggttgggtttcagggagcaactcctgagcgtgccctagccgttcctgctgcctgctctctgtgcctgggaggctgggcccagagtcatccatgctgtggtagtcagtagtctcctctcaacctctcttttccccaccttcctctccctaccctacctcttctgccttctggttgtggctggaaaatactggggactgttaaggtttgagccttgctaagtgcctggcggcctttcccacaggtggcaaattacatcaaggagcagtcgacttgcaacttccaggccatcgtcatctctctcaaggaggagttctacaccaaggccgagagcctcattggagtctatcctgaggtagggcgggcctggctcaggagccagtcctactccctgcctgatttcccagggcaggaaaggaaggctgcagtggaggggaaaggaggtgggggagcatagggaatcaggtcctgaatggccatttgggcttgttggagccctgcctctggaggcttagccagcccagccaggcagggccattgcatttggggacaggtggaaaggcaggcagaggcagccagacagtggagaaaggaggagagtacagaagtaggcaaggagcgaaggcacatgggactgagcatatcctctcacacccagagagaaccattgactgggctttgggcaggtatgtagggaggagggtttgaggcccctggtcctggggcactagacccctcttaattctctccttacaattttatttttctttttctccctcctccttcagcaaggggactgtgtgatcagcaaagtcctgaccttcgacctcaccaagtacccagatgccaaccccaaccccaatgagcagtagcagtatttttgccctcccgccctgtctggatccctaagctgtccctctcccaatctctggatatttgactcccaaccttccccctacctcctggccctttttggtgtagtcatgggatttaggcactgctaatcaagcatgaagaggaacagaggtgatgttaggtctggagcaaaaattcctgaacgacagggagtattctggcctctgaaaggaggtgctgagctgaacagggccatctgttcatcacacacacccccttcctccccctcatcacccataatcgtgggccccttgggcctcttgcccactgtgtgtgtgggtatgtatgtgtgtatgtatgtatccgcatgtgtgcatgtgagtatgtttgcaaaataataaaggatattggagacctgttttagaaggagcctaggctgaatttgattccaagagagcttaggatgacagcacccctgagctgggcaaaggtactcaggacctcataggagtcttaggcagttacctgaaactgccttcattcactcatttgtgtattcattcatttatgtattcatcagacacataccgaacaccctctatttgtcaggctctgtgcttggaatacagagttgaatcagacatgatctctaccctcctagtaaggagatacagtgggttcatgaatgactatagttagctgaatgtcatatgtactttgaatttgagaagtgggtgatcccctctaggcttcctggaggtcacatttaagctagaccttgacaaattggtaggatttggtcaggcactaggagtggagcatgagctctggggacagacagttatgggttctggtcccactttttatcacttactagttgtttgaccttgggcaagtcatttgaccttctgtgcctcagtttcctcatctgtaaaatggggctaacaatattacctacctcataggatttaatgatgtcaagctcctcactggaggccttatcccttcgtggagcccactaggtgccgacccctcagaatataaccctcatgcctggacccctgagagcttctgatcccagctattagggacagaagaagcctccaaatctggaaggtgctgaatgccctgctgactgggaaagtttcagggcactgatggggtctacctggtaagcggagggcctgaggaa

SEQ ID NO: 916 - DNA, 43812 bp, mus musculus; identical to SEQ ID NO: 915

SEQ ID NO: 917 - DNA, 67004 bp, mus musculus; identical to SEQ ID NO: 131

SEQ ID NO: 918 - DNA, 67004 bp, mus musculus; identical to SEQ ID NO: 131

SEQ ID NO: 919 - DNA, 6213 bp, mus musculus
agggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcagtatccttctaatcgatactccgtaggtcagaagcccgtgacaggaaaggggaaggtgggggagggacagaaaaggtaaagcgggtggaggagagccagaggtgggcatgatccccctatcggaagacggactagactgggtggaagagggatggaaggaggagggcaaaacagcagagaagctggactggagatgatgaagggtggtggagggggggcggacataaaaactggaccacagatgggaaagggggaagaggaggaacatagcattaaaaaaaggatcacagatgataaaaagggggagggtagtaaaggggcacacagcaaaaaaattggaccagagatggtgaaaggaggaggggaggggcacgtagaagatgaactgactcagagaccttgaagagggaggggaatggcacacagcagagaaactgcccagaaagggtgcttgagccatacaaggctctgtaaacctagatttttgcttaagatactaggagaccccaatcctggctggagtgccttgcattggagggaggggggctggagcccctgaaagatcaagagagggagtgtctaggtatagagaaaaaggagttaaatgaaggaaaggggagagtagacacatacacatacatgtaacatgttaggaacatgagtcgaacatcctaatagaattatgtggatacagacccttagccctcatatgaaacagcacatggtaagaggcccttagcacccaggcatacaatatcatttagacataggacctcagctcctagacacagtattatgtgaccacaggtcctcagcatgtagacacatggcataacttgaccacaagccatcagagccattcacacatcatgtggacatggaccttcaacacccatacatacaataacgtgaccacaggccctcagcaatcagttacagcatcacttggacatggcccttaagcccccagacgtgcattttgtgaacacaagctttcagcacccagtgacatataccacatgcacatggattgtcgacaccctgtagggccacctaacatagaggtttatcatgggaataagtatgggttatgtcccatgactcacttgctttatacacaccacataagcacagaaggaatcctcatgctccagcctctcttactgtgcccttcctggccttccctccctccctttcacggaatagtcaatccttgacctaaactgctccactcatcagttcctcaaccaccccagaatttcaattttgatcaaccgacgtgatgaagacattttccgctacttgaccaatctgcaggtcaggccagagagacattttttagtaggatcgggcacgaatctggttcttggaggtgacgggaggtgggtgggaagggccgtggtgtgttgggggggggacagattccaccatcacccccacctggagcaggtacaggatctcagacatatctccatgggctacaaaatgaagctgtacttccagactaacccctacttcacaaacatggtgattgtcaaggagttccagcgcaaccgctcaggtaagtggcagtaccagagtaaatccatgttccccccctcaatctgtccttgttttgtcccatctccatagccttctctctccctaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgaggtggggcccttcctggcatcaccagagaaggccttgctaggcttgttcctgggtgcgtggggaattaagaggaggatctggagcttgtactaatggctgtcttattccttctcccctttttcaacagattatcaagaatgatctgtgggttaaccctctacgctactacctgagagaaaggggctccaggataaagagaaagaagcaagaaatgaagaaacggtaatgggagtttggtcgctgagaggtggtttgttggggatggggaaaagactagtgtaacacaggatttatggagccaaaaagggacctttgagataatcccagtggaatatgttttacaagtgggaaatcatgcccagaaatggcttgaggttacacagtcaggggcagaagtgggactttacccaccctagccccattcctgggatcccttatagcctactgcttccccagttacttcccacctttgagtgctatgagtacaccacctcccaccaaccctatactcagccacagccttccttacagtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggtgagctaatccccccccacccttgtcttccctcttttcttttctcagagcaagcctggccaaggacagggtatcaaggcatgaacacaatctgcttttatggaggaaagaaaaagcattctgagcaactttttaaacaaaggaagtccagtgaacatttaacttaaaaatgtaacaaaaccccaaaaaatcattttagttctaggtgatggatagatggttgtaacagcagaagatgaagagtacacagagataggagacagtgggtggaaaactgaaaaggacacttcacatcgaggtgggggagtggcaaaacacagtgcatttcagcacagtctgtacccggccttggcctttggcgcatttccaggcttgtgttgggagcagagcatgaagtgaacagtgtgctctctgagtccagaaaagggtgcagccagttctacctcaagaatcggggtggggggggtggcgggggaagagctagaggaaaaaggtgacatttgaactggaggatgcattcacactgaggagctttatggagcattctccgtggagtggatcatctgaacaaggacctggaagggtgaaaatgcatcgtaggttgggcagggtttccaaaattatgtcctgaggatcactcaccagatctgaaagctgcttcccacaaaaggtttcagtggtcgtatatgttggacaagtactgcatatagtaataccctcttgtagagtcacattagcaccttaaaggctctgagaataacacgagaattataaaggtgctgagaagtactcagatgggaggtggaaggggcaggaaaatcaactactcttcgggtttttttggctatggggtccctggcaaacttccattgagggcaaggccagggcactaagggaagaggaatgaatgtggagcctcaatctagacatgttcaggtaggagagagaaacagggattctcagttctcttcccctcccacctgatggcatctcttttctcagaaggggaggcagagctatctgcccagccctgagggtgggagtgggggtggggaattgggttgcagaacacaaactagggcctctttggatcagactgggggagaaagcgaggaagctgcctggagatgaataggtttattcagctgaggtcagagctcaggaagagacacacattgaggagtacaagggggagaaaaagctactatcagagatgtatcagttttgacagaggcagggatcccacactgccttcctgcctccctccatctccctctcattctgtgggcttgcttgagtacacccacacacactcttggctgtttgttccaagcagaggcgctgacaagttgtcccaggccgctaaaaaccctggctatggtctctgttcccttttagagtgacacctatctgctcatctaactgccttcctccatttccccttccttgcttctcccctatgcaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcagagtg

SEQ ID NO: 920 - DNA, 6213 bp, mus musculus; identical to SEQ ID NO: 919

SEQ ID NO: 921 - DNA, 6213 bp, mus musculus; identical to SEQ ID NO: 919

SEQ ID NO: 922 - DNA, 3256 bp, mus musculus
caggagagaaggctggctgaggagcgcctggacagcagcagttgctgacgttctatatcacgcgcctggggcccaaggtaacccagacctttaaacaaactgccgggctgggggtgttgcgggggcaggagagggaaaagggagcggagacttcgggggtcgcgcgaggatagtggtggccatagaggtggcaaatgcgtgaagggagggagtagtaatccgaattctaggagaaatcataggaattgaagtcgcagaagcaagaaaaggggtgtgagagcacaagcgcgaaaaagcgtgagagggcgcaagagctgggtggaccgaaagtgcgctgaggggcaacggcttagagtggaacacaccgggtcacagaagtataggttaggtagaaacagagggacactttcttcctgtgagttcattttccaaaagtgcgtcctttcagccattttggagagaaaatgttgacccaagtgttttttaggatacagggaaagaacgtcagaggaagctgcaccaaagcgaggctgcgcagggcgcaaaaaagcagtcagagggtggcgccttttttaaagaagtttccatcctttctgtcctaaagctcaggccgttccccacccccaccgctcgctagccttctgttcccagtcccctggcatgatctgatcgcctttgaagcaggtaaccgcctcggtctccccatcagctccaggggcctctcagttgagtgggtggagccgacagaagccgcgggctgagctcaagggccgatgggaggggtcctgggggcgctaactgcgcaccgcggccatgacgctgggcagatcattcacagaagtctctgtctcctttcatctacagtcgcagctgttttccagacgccttgctcctcaggtcggggagtgatctgatggcccaggttcgagaaacttctttgccctccggctctggggtccgctggatctccggaggtgggggaggagcctctcctgaggaggcggttgagaaggcggggaaaatggaggaggcggcggcgggggctacgaaggcgtcttcgagacgtgaagccgaggagatgaagctggagccattacaagagcgtgagcccgcgccggaggagaacttgacgtggagcagcagcggcggcgacgagaaggtgctcccttcaatcccccttcgctgtcacagcagctcctcgcccgtttgcccgcgccgcaagccccgccctcggccccagccccgggcccgctcccgcagccagcctgggctctcggccccacccccgcctccagcccggcccccgcccccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaggtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaacaaaagaaaaaattttgagattattaacttccacctcaacagatgtttctcatcaacagtttatgacatcagggtttgaagacaagcaatcaacctgtgagacaaaggaacaggagccaaaattggtgaaacccaagaaaaagagaagaaaaaagtcagtctatactgtaggcctgagagggctaatcaatcttgggaacacttgttttatgaattgtattgtccaggcacttacccatattcctctactgaaagatttcttcctctctgacaagcacaaatgtataatgacaagccccagcttgtgtctggtctgtgaaatgtcttcgctttttcatgctatgtactctgggagccgaactcctcacattccctataagttactgcatctgatatggatccatgcagaacatttagcagggtacaggcagcaggatgcccatgagttccttattgcaatattagacgtgctacatagacacagcaaagatgatagtggtgggcaggaggccaataaccccaactgctgtaactgcatcatagaccaaatctttacaggtggcctgcaatcagatgtcacatgtcaagcctgccatagtgtttctaccaccatagacccatgctgggacatcagtttggacttgcctggctcttgtgccacattcgattcccagaacccagagagggctgacagcacagtgagcagggatgaccacataccaggaatcccctcacttacagactgtctacagtggtttacaaggccagagcacctaggaagcagtgccaaaatcaaatgcaatagttgccaaagctaccaggagtctactaaacagctcacaatgaaaaaattacccattgtggcttgttttcatctcaagcggtttgagcatgtaggcaaacagaggcgaaagattaatacctttatctcctttcccttggagctggacatgactccgtttttggcctctactaaagagagcagaatgaaagaaggccagccaccaacagattgtgtgcccaatgagaataagtattccttgtttgcagtgattaatcaccatggaactttggaaagtggccactataccagcttcatccggcaacaaaaggaccagtggttcagctgtgatgatgccatcatcaccaaggctaccattgaggacttactctacagtgaagggtatttactgttctatcacaaacagggtctagagaaagactagtcttaccagaccacttactgaaaaaaaagtaaatgattaggcaaggattttgaagtgacacacagacctacttggaatggacaatgacagtaacacctatgtgacagctagtatcttgatataaagaacctattttagcatggcccatgggtctgtcggaagaaaaaaatgaatactaaccagtgaccattcaaccttaagaaatgg

SEQ ID NO: 923 - DNA, 2067 bp, mus musculus
caggaagctaagctaggaaaagagcgaggagattgcaacagcagcaacggctcctggaagtccagtgtagcagaagggccgccaccgacaggaaggcagagggctaacaagcctagtgctggggatgctgctgccttccctttcgcctgcctcacaacccttctagacgttttccacgcctacagatcctaccctcctagcttttgcaagcgctcactctgttagtggcctgctgatcctccttcgccacaggctcctagcagaggcaacagtgaggggtctgatttgggcgcgggaggtggcactgccacctctccggcagtgcgggaggtgggcggcgcgggaggtgggccctgggctgcggaaccggaggatgggggttggtgggggccaggcgtgaaaattcgggtgggtgctggcgtaagaaatgcaggagactgggaagggtgatttgagggctgggggcatgaggacctgaagagcaccaggatggtatacaaaggtggccagaaagggaaataggtttgtggttggagcccagaaggaaaatggagtttaccaggaagagacaggaaagagaggtgagcaccaggcgggaggcgagggatgggaatgtacgggggatgaataccacagagccatggggaggggacatggagactgcatgtacagaaatggaaaaatgaggtgggagctaaaaaatggagaatgttgggagatgtgataggatggcgacagagggtcagggaataggcaaagtagcccacttccttttgctgtgctctcaactaccacggccaccacacctacctgttctctatctctcttgtgcagctaaacaagcctggaaggaagacattgtaggcaggcatccaagagtgtcttgatatctaacattgctactggacacacatgaacaacatgggtggcaatgtacctggtgcacagggacttcatgatagaagaaaaaaactcatacatttaatgtttttccctggcctctctccttcccctccaaatatgaagactctccttcacaaaaaggcagctgcaaagctgccaaccagggaagccataggtcaccacactggaactacaaacatgaggaagaaaaagacatctccaatgaagccaagaggaaggtcttcctctcagtcctgcagacacatggtaggctgcagaatttcacatggatagaagaagggagatgagcccatcacccagtgtaaagggaccgttctgaatcaggtgcctatatatccctttctttatctggtaaaatattatggaattgactgtgtttatggactagaacttcacagagatgaaagaattttaaagcttaaaatccttcctcataaggtgccattctcacaagtcagggatttctgccttgcaaataccataattggcaaagcagtgaaacacatgtttgagggagagcatggttctatggataaatggagggggatggtcctagcccaagcacctatcatgaaagcctggttttatattacttataagaaagatcctgtcttgcacatgtactagctactcgatgattataaggcaggtgacctctgcatcatgccagaatcaagtgtgtctcatccagtgaagagggaaccagaaggatttatagatagcctgatagataaacatgtggaatataccaaagaagacgactccaaaaggacagacaaggtcatccaccaagttaaagccaaacctgtgtatttcatcgtttgatgatgacttccatatctatgtctacgatttggtgaaaatatcttgttagagtaaaatttgctacatttgtggagacaaatgtgtaatacgcaggcaaacaaaaaaagtacaacttttcagggtgttgaaagctcaagggtcctgatatcacaatatttgcctgcataactgttgttttatgctgaaaaatacaaatttatatgacatgtataagcagtttgtcttgttgaaaagattgggtgtgttttgtggatggggcatgaaaggaaggaacagctgtcaattccaattgtgaacaaagttcagctagaatcacaa

SEQ ID NO: 924 - DNA, 38669 bp, mus musculus; identical to SEQ ID NO: 133

SEQ ID NO: 925 - DNA, 399 bp, mus musculus; identical to SEQ ID NO: 134

SEQ ID NO: 926 - DNA, 651 bp, mus musculus; identical to SEQ ID NO: 135

SEQ ID NO: 927 - DNA, 97914 bp, mus musculus
aaaaattaaggaaaattttaccaatcttaaaaagcttagttggctaggataaaatatttgcaacatttaaaccagaaattatctagaatacaagaaactcctggaaatcaaccagagtagcccagtggaaaggtgggcaaggattgaacagggaatttacagaagggtaaaccagatagaatggctaatcattttgtgtagattgagaacaatgccaagagaggaaaaacaaatagaatgatagcttttatgcagtgtcatttatatacaattaaaatacatgcgtatcttcaaaacagtatttcaaaattgcagctgcaaagatatcagaggaggtgtttataattagggagaggaatggaaagtaaaaggaccccaaaaatagaataaaagtagagagggatgctacacacacatgtccatgagctcaagagttggatgaattgaactcaccaaaggtccctaagataagggaggagaaagtgacagctcccacgctcttaatttggcttaatctcaatgtgttcgagttttcattacagctcagggtaccagcccccacctgctcactttcctactcatttatgtttaaacttcctggctttctcaccacacttgaaccctactcccggcacacctttgggcgtgtcaggaacacgttcatcacaaacattttttgtgccacaaagggactttcccagctttggccaagagtacaggtgcccattcctgagagtttcagcttcacattaaaaaaaaaaaaatgagacataattaagggaccataaaattcacccgcttaaaatgtacaattcaatagtttttagtatacttagttgtgcactcatcataatcctagaatattttcatccaaaaaagaaaacctgtacccattattcagcttcatttttaatcgtgtatatctccccccaggagtggtaataaaactttcaggctggtcaccttccaacgagaaaaaacatgcagcctggggctccatgggaacgggttatcacttggcaggcctgggtaaacaaaaggcttgagccggccctgccaagatgtctttttcaatgtttttgaaaagataataaatgtgcatggcagtggtaaaagtgcctacttaggaggcaacccgtttagcagtttcttgtgtgtcttctcggagagatcctcctcagaggttttttgttttattttgcttttgagacaaggtctctgtcgcccaggctggagtgcagtggcgtgatcactgcagtctcgacctcccgggctcaagcgatcttcccgcctcagcctcccaagtagctgggaccacagatgagtcgccatgcccagctaatttttaaaatttttttgtagagacgggggtctcgaactccttagctcaatcaatccgcccgcgtcagcctcccgaagtgttgggattacaggcgggagccaccacacccggcatcgcggaggtttcagtcagcattatttacgcctcaggagaagaggaaccaaattggctgcggagtagggtgtcgttgaaaggcctaggtcggcctacggcgcgtgccgctgcctcttagttgaagatcgaccccaatagcttgctgctgtccctctctgggtgaccgcacgctgagggtggggcgtcactaaacactgattacccgtgcgcctcgaaaactggaacctaactatgcatggagggcgggtcctctggcgtctgcacagatgtcactggcccaactggcacccacctgggggcctagccagaaattgttcccaaggctgcattgctgagtttgcatgcagacacccagtgagtgtaagcgtgtgcgtgctgagtgagcacgtgtgtgcgcgttatgtgctctgtgttcacacattgagtgaggatgtgtgtgcacggtgtctgagaaactgcaccctacatctacacacgctttgagtgtgtatctgctactgtgagaagatgcatttacgctgggtgtgcacgttgtgtgtgcatgttgcatgtaagcatcgtatgaagaactgtgtgcgtacgcacgccttctgtgtgtgcactgtgtacagcagcgtgtaaggacgcgtgcacgcccgtacgcgctgtgtgaggactgttgtgcacattgcatgcacacgctacaagcgcgcgccgcgtgagaaccggtgcgcctatcgcacgtgcacgccctgcgtgcgctgtgcgtggaagcggtgcgcctatcgcacgtgcacgccttgcgtgcgctgtgcgtggtaaccggtgcgcttatcgcacgtgcacgccctgcgcgcgtgctgcgtgaggacgcgtgcgcatgcggacgcgcgcgggttcggtgcggcgcggcgggcttggcagtgcgcctgtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggtattatccccagagtgtggcgggcgcccgagggcttcgggttcctgtgggggggcgggcccggcggcccagggcaaaggtcctcgagcgtggggggaaggggcacggcgcagagctgagataaacgccctttccctggcccaggatcgtccggacgtgcatccaagggccgcacccctctctgtgcgagtggcggggttctttcttggggcgacctgggtgagtgggtacacatggggggtggcttagggtgggcggcaggtgtgtttgggatggaggtgcctgagggggtgctgcgggtccagtccccgtcctcgaggagcagccggcatgggggtcgttaggataaaccgagcggggttctggggttgccccggcctccgcgcgcgctctctctgcgttctgggaaacgcgcgcgagcgccgctgcagcccgcggcgaaggtggcccagcttcgcgcctcttggcgtttccagggggcaaaatcggcgtgtcacccattggcagaggcagattcgcccgggcggccaggcgtctgccccggaccgggtgctcctcccgcccggatgcgctccctgtcttgggaacgctgctcaggtggccgggccgcggccctcaatcgaggcagcggggcaaacaaggctctcagccctcgaggctgccgatgctgggagccatggagggctggtccctggctgcccagaagccagcgaggcagcggaggagactgtgaggacatttggcaggattttagataagcaggtctgatgctaacgttctgtaaagtggttgcaggtagtgcgggggtgtaagcagcatggaaaccgatttcatgctgtttttcctgacaacaacttttttatttttagttaataaggcaggctatttttaaaacattttttattgcagtctaatatgcatttaaaaaaccacacaaaactataattcgatgaattatcacatagtgaagatgggagtattttatatacgatgggccaagaaaaggaaagaaatcaagagaaatcttcttaaaacacgctttttcactggggttgagggggcgaggtagtattttctgactgggccttcagttgcatcattcttaggaggaggagatagcttaaatcatttccagtttgtatttttcattatgctattttaaaggcagaattcattaactgtcacaggataacgttataactacctttgaaatgtgtgcttttgtttttatcctttttgcttgaaacactcaagctgcatctgctagggaagaacctggaaactacccaccagaacgaccctccgtggcagaggcgaccttgtataataaaacactgaaaaggagaggttgtttcagtttgcatttttatttggttgagagcttaaataatagtttgtttcgatgttctgttgtactcatgagaggtggggaggggcggtatgattgggttttcagtgtatcttggattttatttgaaggaacttaaggggtttttttttttttttttttaatggaaacaaaattggggaaggggaggaggtacttttgcgggggagattcttaataagttctgtttggaaactattgtagaatcatttaatgcactcttctgatattaagattagcttaaggatatcttccttcatttgaaattggaaatatagaaaaatatgtgtgaaggtttaaaatgtgaaataagcacctatgtgcattaaggttggtatggtaaaattggaatgtttaatttaggtgccaggtgataccaccatttgttgtttgggggagttagcaaggccaggtacttaagtaaagtctccttagaaaaattatgattttgaggttttataattatctgtcctggatactgatcattcttggttacccaggcccttagcatttgggacccattcctaatgagacttaacctgcttttctagagagtcaaccattgttcctaagcttgggctgggtgctgtcaaggctgcaaaatacagaaagacctgagatgtttaggctgtccaacaattttgtgttgcacacttaggggatatgagttggcaagtggttttcctgggagctgtgtaaaagacggaaaggaaataccgctggtggtttcctctagcaacaggttcttccgatattgaaatcctgtgcatgttcccattaccccctagtgatgccttctttctttccttttaattacctctgaatagaaattaccagatctactgtccattttagtgcttgtctgatacacatagtataacaaatgagcaagtgcttgtttcaatctgcttaacaacctttaaccagcagatagaatcaccagatctcaaccatatttcctttctttctttttagatgaagtctcactctgttgtccatgctggagtgcagtggcacaatcttagctcactgcaacttctgcgccaccatgcccaggatcccagcactttgggaggccgaggcaggtggatcacttgaggtcaggagtttgagaccagtctggctaacatggtgaaaccctatctctactaaaaatacgaacattagccgggcctggtggcgcatgcttgtaatcgtagctacttgggaggctgaggcataggatcgcttgaacccaggaagcggaggttgcagtgagctgacctcgcgccactgtactccagcctgggtgacagagcgagactccgtctcgaaagaaaaacaaaatagggtggggcctggagatagagagtaggtggttattggagactgcgaagggtactggggggtgggaaggaggtaggaatggttaatgggtataaaaaaatagaatgaattaataaggcctggtatttgatagcacaacagggtaattatagtcaataataatttaattgttcatttaaaaataactactagtatgactggattgtttgtaacacaaaggataaatgcttgagggggatggctaacctgttttgcatgatatgattatttcatattgcatgcctgtaccaaaacatctcatgtaccccagaaatatatgcacctactacctactatgtagccacaaaaattaaaaattgtaaaataaaaaaaaaagtagagtgggcccgagtagcaaaggcattgggtccccaagaaatcggagttcttcatcctttttcaaagttgtgtttaaaaccattcttgaacgctttaatcctaaaactgttcagatcgctgggcgtggtggctcacgcctgtaatcccagcactttgggaggccgaggcgggcggatcacgaggtcaggagttcaagaccaggccggccaagatggtgaaaccctgtctctactaaaaatacaaaaattagccaggtatggtggcaggcacctgtaatcccagctactcgggaggctgaggcagggaattgcttgaacccgggaggcggaggttgcagtgagcagagattgagccactgcactccaccccgggcgacagagtgagactccgatcttaaaaaaaaaagtgttcagatcaagaagaacaagagaacaagttgagtttgtgcctctagagtctctttggtagtaggaaggaccacaaacttcctacaaagttgtatttggtttgtggctcctggctttttttactgatggcagcataggacttagacttagcaggaccttcaggacaaactgctgaaagtctttgtgatttctcttctcatatcctagccatggtgacatagctgctcaaagtctgtcatttctaacctgcttcctctccaacatgaaaggatgttttcctctcaggtgccccatcttctgcagtggctagtgttttaaaagaacactttgtcttcttgtaattacattgattgccttacaaaacagaaggattcacaaggttgatttgggcaggcgagagatggagatttctgggggctgttggtaaatatcctggtgggtcttgttgagaggatttgatgagatatattggctggtgatacaatgatactgcctggttttagggggctgttcatgtgctaagttggctcaggcggcagttccaagatttgaaaacttcccatggccctgccctccggtcccttttgaaaggaatttcaccagaagaaggaagagggggtagtagagggcagccgcccttagggagggagtgtccactgtccacctcacatctgagtcggccgcatttaaatatggagtttaccgtcttggcatctgaggctctgggtctgactaggccttgggatcccgcctcgtctgcctctgaggtcagtctgaatgcaagcccccatctgcttttctgttgggaagcatttgttttcctcttgcctaggaactttttctgtttttaaaagccttgtgactagcagagtttgggttgtcatttaagcgaaaggaaaacaggtatgagtgagccgcatgcatgcaaagcatttgaggcaacagcagtgatgccaaatgcctgagatccttggaatgacagggtctgtccccagggctcctagcttctgaccagtgctgggttcgttcaccacctaaaaagacttggcttttcctctcagtgccaaataggttggtgccttgtagcccccaggcaaccctttggaatgttccttgctcctttgtcatctcacccgcttcatccgtcccaccctctgtgtttctgtaataacagctttatggctggtcgtggtggttcacacctgtaatcctagcacttcaggaggctgaggcccacagatcgcttgcactcaggagttcaagaccagcctgggcaacatggcaaaaccctgtctccacaaaaaatacgaaaaattagctgggcgtgatggcacgtacctgtagtcccagctactttaggggctgaggcgggaagattgcttaagcccatgaggtcgaggctgcagtgaactgagattgtgccactgcactccagcctgggtgacaaagtgagagcctgactcaaaaataaaaataaacagctttatcatctgtataaaattcatatgccatatagtccacccatttaaaatgcacaattcgatggtttttagtatattcacagagttgtgcagccatcaccacaatcaattttagaacatgttcaccaccccacaaagaatccccatactcactgacattcttcattcccccggcctcacaactacccatctgtctatatagagaccacgagacttctgccgggacagtcttcagcctttggtgcagacacgcgttgcaattgcctagaagtctgtgggtgggtcttcatgcattagaggtttagaaaccaatattctgcatactctgtccttcaggtctaagacgcgcttttaccctgaagccttgccttttcacctcctgtacattcccactccacagggcctgcaaagcgctcagaacctgaatgtaatgtacacagcggtctgcagttatatactgcacatgttcattttagcttcccagacagtaatggccgctaattgttgagcacttatgtgccaaccctcatagttctgggggttgcctgggcttattggagaagttctgctgctccatttggggtcacctggagtccctcatgctggtacagtctgctggtctgctgggagctcagttgggctcgaaatgtccaagatggtctctcattgtccaggtacctaatcacagagagtctgtcctggactttctaacagcgtggctgctgtgctttgaataaggaagcagaagttgccagttctcttaaggcctgcacatagaagtcccagaatgtcatttttgctgtgttcagtggtcaaagcaagtcccaaggccagcctagattcaaggggagaggaaatagactccacctgttgatgtgagggcagcatgcacctactgggaaatgagaaattgttagtggcccttttggagaatatctactgtaataggcaagtacagtcgttccttggtatccatgggggatttgttccagcacctctcaagaacaccaaaaatcaaggatgcccaagtccctgatataaaatggtatagtatttgcgtgtaacctatgcacatcctcccttatactttttttttttttttttttttgagacagagtctcactttgtcacccaggctggagtacagtggcacgatctcagctcactgcagccttgacctcccaggttcaagcaatcctcccacctcaacccctccaaggagctgggactataggcatatacctctatgtctggctcatttttgtttttgttttggtttttttgagacagagtcttgctctgtcacccaggctggagtgcagtggtgcgatctctgctctctgcaacctcgcttcctgggttcaagtgattctcctgcctcatcctcccaagtagctgggactacaggcatgcactagcacgctcggctaattttttgtatttttagtagagatcgggtttcaccacgttggccaggctggtcttgaactcctgacctcaagtgatctgcccacctcagcctcccaaagtgctgggattacaggcgtgaaccaccgtgcccctccctcccttacactttaaatcatctctgggttactgataataaatgtaaatgctatgcaaatagttgctatactgtgtcgttgttttgggaataatgaccaaaaaaaaaaaaaaagtctgtgcaaccatccactttattttatctgaatatctgaatcttttctttttttttaagatggagtctcaccctcttgcccaggctggagtgcagtggtgcaatctcggctcactgcaaccactgcctcctgggttcaagtgattctcctgccttagcctcccaagtagctgagattacaggcctctgccaccacaaccggctaatttttgtatttttagtagagtcggggtttcaccatgttggccaggctggtctcgaactcctgacctcaggtgatccgcctcccaaagtgctgggattacaggcatgagccaccacgcccagccttaatctgaatatttttagtctgtggttggttgaatccttggatatgcaacccttgaatacagtgggctgattatatgttttaattaagaaaggttatgtattcagcgagaggtgagagattaaaaaaagaagaaaggttaagttatttgcccaagggcacacagtaagtggcaaaccaggcttcacacccaagtgtgtttgacttcggagctgagaaacttttttttttttttttttttttttgagacggagtcttgctctgttgcccaggctggagtgcagtggcatgatcttggctcactgcaacctccgcctcctgggttcaagcgattctcctgcctcagcctcccgagtagctgggactacaggcgtgcaccaccatgcccggctaatttttgtacttttagtaaagatggggttttaccatgttgtccgggctggtctcgaactcctgaccttatgatccacctgccttggcctcccaaagtgctgggattataggcgtgagccaccatgactgacccagagctgagaatttttaaccccccgtgccactgtgcctccacggatggataataaactcctttcgcgcatgagctgtgtctcccacatctgctatacccctctgaggatctagctcagtactatctagccacatcttacaaagatcttgtatgccttttacttagtacacagttgtttttctccccaaaggcgatggggatctcatttcttagaattacagcaaaaatgttattaaaatgcttagaggaagataagttccatttaatggaatttcctagtttaccaggaatgaaccccccatcctctctgtgcccacaattattgttaaggatctgaagatacccttaatcggcttcctgccttaggacactgtgttgggtatgattgaggttcttgctgttaactgtggtcattgctctagaaggaccctggaagattctctgatactctaggctagtgtgtctcaaactaactctggtaaaggagcagtttttagtttttttgtttttttttttttgtaaatttccaatctgctgttgaccagtatcttggtaaaacacagtaaagaaaaatatatgaaagacatggaaaatacaagtcccaatttttaaatatcaggttagattaatattagatttaaagagctcattaagtaacagaatactctgtccagttgctgtaaatgttctaaatgcatgccctcggtggggtgcagtggctcacacctgtaatcccagcactttgggaggctaaggcaggcagatgacttgaggtcaggagttcaagaccagcctgggcaatatggcgaaaccccgcctctactaaaaatacaaaaattagccagatgtggtggcgcatacctgtagtcccagttactcgggaagcggcggcacgagaatcgcttgaaccagggaggtggaggttgcagtgagctgaaatggcgccactgcactccagcctaggtgacagagtgagactctgtctcaaaaaaaaaaaaataaaataaaaaagaagcatgctctcaatttatgcctttattctttattgcagattgataatgaataataaagagattgtgctccctccccacagcccatcagggttaggctgctcagggtttcctgaagaaaaaaacaaacaaacaaaaaaaacgtaaaaaagagagactggcacctgtccacaggacacactttgaatagctctgccctgggccagtatttcccaaagggtatggtacataagagggttttagattgcatgtggacagacttatctttttaactttagattaatagttctgttgattcttcaatttattttaaaactacaactagtacatcatgctacagtttctgaatattttcagaatgagtaaaaagtgaaaaaactacaaaaactaagcgaaaataagtcaatttaaagaaaaagactatccactgggcctggcgtctaggaaaaaaattttaaaaataaaaagaccaaataatagaagtcagtgctggctaatacaaacagaatgctagccacatatgtaatcttaatttttctagtagacacattaagaaaaagaaacggtgaaattaatataatacaacttacttagtcaagtatgttccaaaatattatctttcagcatgtaattaattaattaattttggggggggcgggaaacagagtctctctctatcccccaggctggagtgcggtggcgtgatcttggctcactgcaacctctacctccccggttcaaacggttcttatgccttagcctcccaagtagctgggattataggcacatgccaccacgcctagctaatttttgtatttttagtagagacagggtttcaccatgttgtctaggctggtcttgaactcctgacctcaagtgatctgcctgccttggcctcccaaagtgctgggattacaggtttgagccaccgcgcccagccccttcatcctcttatgtaccaagttctctcccttaaccacactttccttccctaaagtaggtaaaatttggcaaaacaaccaaccaatcctggcttcccctgtgtgaaaccaggtccctcacaatcctctccaaggatgagcattccttctgtctctgctgaaagaaccagacagcacattagatttcatcattttccccaccgccctctgctgtgggctaccccgagcctaccgcccttgccgtcattactaaacctccaaagttcatcagctctgtgtgtagtcctttttttttttttctttgtagaggcagggtttcgcgctgttgcccaggttggagtgcagtgctgccatcacagctcactgcagccccaacctctcaggctcaagcgatcctcccacctcagctcccaagtagccaggaccacaggtgagtgccaccatgcctggatcatttttgaattttttttttaaatagagacaggtctcatgctgggattacaggcatgagccacctcacctagcctcagcatgtaattaatattaaacgttattaatgagatatctgacattcttttctttgcagcaagtctttgaaattccatgtctattttacacttctagtgtgtctccatttggactgtttgcgtttcacgtgctcaatagccaactgcggctagtggctactgtattgtacggcactgacctagagcatttccatcacgcagggagttttgtggtctacattgagtctcatggtgactaagtattcagtgtgatgactgtgctgtcaagtatggcgtgaagcacagtatgtgtgctgtggtagtgagtccagcttggatctcttcttcatgaatgtagaggaaatggaaacacactttgatggaatgggctcccccatatcaggcaaagcaggcccggattccccaggcttttgaagggatatcctgattttgctttccccagcctgggtgaagggagtgcaccaaggctgtgactagtgggtcctcacacagattattgtcttggggacctgatagactgtggaaaggggatggacttggctttgtgggaattattaagctgtcatcgaggaaaagtgctaaggtttgaatgtccattccaaaactcatgtcaaaattgccattgtgatggcattaagagatgggacctttaagaagtgagtaggccatggggctctgccctcatgagtggattattgttgatagtggattcggtttggcccccatttgctctctctgtatcatgggcttgcttgcccttttgccatgttttgatgcaagaagaaggccctcaccagatgccaagcagatgctgacaccaccagcatccagaattgtgagccaagtaaatttgtttgttataagttacccagtctgtggtattctgttatagccactgaaaacagactaagacagaaagcatggtattgaaaaaacatggaaccataactgtgggaggagagagctgtattagccagcttaggatctcctgggtttggtgttggggtcggggtcaggaatccctgctgctgggtagggtctgctgagtcgggattcaatgggctctgtgagattcgatctggtcatcttccccagctggtgtcatgtcttcctagtgccttgtccacagaagccacttgctgattctgaccaataggtactgattgactgttaggacagatgccctaactctgggaactacaccattaaacagggaagttccagtgtatctgggctggttctgcctccatctttctaggtttgatgtgaaagagctgccattagttacagatggccttagtggactgattacccagcacctgcttcagggcctgcaggatgaaccccttcccagaccagcttgtctccttcctgagcagttggtctgtcttcaccgttggtcactgattccttcagagttgactcttggtttagcaactcaaccagtgtggtactctggttgctgtggtagatgtatgggattaacgtccttttcagctccattttttatccctacccttgtttttctctttctctcctactttctgtatttatttctactgtattttatataagcaatcttaatcttttctggaaggagggagggagggcaggaaatgacctcgcagctggagtctcaccaggcacctgcagccctttattaagcagtgctctatgtccctgtttcagaacaacaccttaatatgtgctattaacttgaagtaaccgtctgaatcgtaaactgggcaaaaccgaattctgctgatgtgcttattcttaaaaacagccccccatgggattcctgtatgttctcttccttcaatacctagcgcgttttcagcactacatttaccagagggaaagtgtattgttcatggggatagcatcacctcttagcaggtgttgctcttttctaccctattaattgtatttgtttagttttcttgatcaccagtcaggggtgacagtgggtggtgaaatactgtgacagccttcagtggaagctttccttgtacctgggtaatttttcccctggtggagatacgtgttatgaataaaatttagcattgatcattttcattagctagataatcaatatttttaagcagttgtagttatgtctacagaccaaaagctcttttaaaaaaatcactaattctaggccaggcgtggtggctcatgcctgtaatcccagcactttgggaggccgagaggggtggatcacctgaggtcaggagttcgagaccagcctggccaacatggcgaaaccccctctctactaaaaatacaaaaattagccgggtgtggtggcgcacgcctgtaaccccatctactcgggaggctgaggcaggagaattgcttgaacctgggaggcagaggttgcagtgagctgagattgtgccactgtactccagcctgggctacatagcgagactctgtctcaaaaacatcataaactaaacattaaaaattatgcattttaattgccattttcttactgcaaaacatgttcctgctctccctttttcctctcctcacccacctaaatttccacttcacttgattttacttttgccagtcacaaatttttttctgaagaataattgcttcttattaatagtccattgagctccacatatccctaatcttctgggatgagattaaccctttttatagaagaacaattaagtgaggaaaatggactgtttcactataccctgttcaactttaatttctcttagttgtgttttagtttctctgtttcaaccaagaggcccaagggttctcagtgcctttctactggggagtgttgaatgtcctttgtggtacatagttttatctttactgcttaaaaatcaaaaggattatttacactttggcatgtaaagattatatcagagcaaatggctcttaattcaagcagagataagacatgcaaggtacaacactgtccagtagaactttctgtgatgttggaaatgttctaggtctgaactgttccatatgatggccactagccacatgtggctgttgagcattgaagacctgagtttttaattgtttctaaatttaaaaaaattgaatttatatcagcacatatagtagtagcttctgtattggactgtacaattaactagctgttgactaacctcgacagattaggatcaggaatgaggaaggagtttcagatctcaaacaaagttacttcaaacccacctactcttggtttctcctgtacaggctttgatatttggcacttgtcattcaaccactctcagatgctggtaggccaccaagaacagaaccagcagttagctccttgacactgtatcaggtctgtaggacagtgatcgaactggtagacaagacttgttcctggctccgtggtggccctggagtgcccacagtcagccaatcctctctgtcctgtctcagcttttcaacttggcacaactgaagagtaaaaactggagccagggtctttagtttcacaacttggttggagaaaccagattgacttacaagccattaccaaaccattagataaaaccagtagctagctatgcaggatttgggtgagctgtgggcagagcttttccagcaaaaggttggcagggacctcaaccacaccctaggccagagaaccccgtggcaggaagtgaggttggtgggggcattggatgcctttgctgagttaatcgtgttccctgttctctagcaagtactcagtaaaatggataagtctcagctctttcattctagcttgctccttacaaactgcggcctcagacattggcccctagaactcagttgcttgtctgtacaatgagattgtacacaaggtgatcttactggtgcgttccaactctgtgatgctgtgatcctccacagctggcctaggaagcagagggaagcatatggctgctatctacccttctcattagtgggatcaccagccacatagcttagaacgactcccccccaccccgcccattacagccaaacccgagggttctgccttctttatctctcatgaccgcatccccatggccagtgctttgggtcagactctgtcatctagagcctcaccagtatcagaagaaccttagggatctctgtccgtccgtccaggtcaccgtccctgtcatggatccttcatgtcattctcttgctttaatctcctctgacacttgcctagcacttcttaaagagtatattctaaactgctgttggagttttcaggcatgttggaatggggctccaatttacccctccacccccatctctctggcctgtaaccactcccgctcagaatgttcagcacactttgcacgtgactgcttgtgtacatgctgttctcttcacctggaattcttttcctctctgtgtctgccatcttcattcctgtctaccctgttcatctttcagtacttggctcacacctcacctcctctctgaagccttccccaaccacacacacttttgatggttttttcccttcttattcattttccattacagcattgattatgaaaatgcagataaaccatgtgcaaataaaactgggactggcacttggaaactaaagtacacaaatcttaagtgcacagtctgattatgtatacaaccatgtaacccacacccagatcaagatgttaaatactttcagtacccagaaggctccttcatgcctcctcctagtcaatacttctctcaaaggtaaccactgttctcacctcttttcactatagatttgctttgcttatttttaaattgtattaaaatagattcatttaggagatacttttttattgtgataaaatatatgtaacataaaatttactgttttagcaattttgaagtgtacagttcagtggcattaagtacattcatgttgttgtgcagccaccaccacaatccatctccagaactttttcatcaagtatatccttctttgtgtctctttttgttttcttttcacttgacattatgtctgcaagattcacctatgttgtcacaggtaccagtggttcatttctttttatttctgagtagtagtactttgtgtgactgtatcacaatttgttttatcaattctcttgctggatggacattgtttttttccagctttttattcttttgactaaaacttttatgagcgttatgcttgtgcagataccttgatgcccatacatttctgttgggtacatacctagaagtggaatgggatctgaaatgtcacttcatagattctatataaagagtgtttgtaacctcctgaatcaaaacacaagttccattctgcgagataaaatgatacatcacaaagcattttcacagttagcttgtttctagtttttatcgcttgatattcgattttttcttataggcctcaatgggctcagaaatgtcacctcgtagattctacaaaaagagtgtttccaacatggtaaatcaaaacacaggttccattctgtgataggataggcatgtcttcagcattagcggatattgccaaaccattttccaaagtggcttgtattcatttcttattgctgctataacagattatcacaaactttagtggcttaaagcaaaataaatgtattatctcaattccagacgtcagaagtcttaaaatcaaggtgtcagcagagcctttcaggatgtgctaagggagaatctgtttccttgtcctttccaacttctttttttgtttgtttgtttttttttttttttgagacggagttttactcttgttgcccaggctggagtgcagtggtgcgatctcggctcaccgcaacctccgcctcccgggatcaagcgattctcctgcctcagcctcctgagtggttggaattacaggcattcaccaccacacccagctaattttatatttttagtagagacagggtttctccatgttggtcaggctggtctcgaactcccgacctcaggtgatctgcctgtctcagcctcccaaagtgctgggattacagacttgagccaccacgcccggttgtcttttccagcttctagaggctgcctgcattccttggctcatggccccttcctccgtcttcaaggccagcatcatagcatcttccaatctctttctctcttgctccttcccctccctcccccccagctctacttccactgttacatctcttctctctaactcacctacctctgttgtgattaccttgggcctacttggaaaatcctggataatctccccatctcaagagccttaacttgatcacatctagaaaggtctttttgttatatgggatagcatattcacaggttctgggagctagaacatcgacagcttggggccaatattttgccagccacatggctgtaccattttgtattcccaccacagtgcatgagagttctagttcctctccatctttgtcagtacttggtatggtcagtcttttgaattgtagctatactggtggagatgtaggggcaagtccaaggctgccaccccaggcagtgcatcctcctttgctccagtgatagctttattgcaacttataagcattatattatgaatatgtatttacattcctctgtcttagccaaactaagcaccacttcatgagcaggctatatagtagttgatttaataaaaggtccttggatgcgaagaactgactgagggcagttttcagcagagcagggaagcagagctgaagatataaatgaaagcccatgcttccagtctcaactctgctcagcccccaggatctgagggaagtaggatttccctcaaataaaaataggagtagagcaaagaacctggcttccaccttctgcacactgttgtctttcccaagatagttaatctataagtgagtaatgccctagaaggaaatttgggccttgactcctatgggtgttggttggaaatgacttcactgtatatgtaaatgagaggaaaatacagttccagctggctactggggagtctgatcttggaccctttgcagggactcaggttttccttttccttggactctgctcatgtagcaacatactgcagcttcttacttacagaaggaaagactccaaggtaagtaatgctttcttgatctcagggaatgtctgtcatgtgtgtagacttaaacccaccttggaaacttgaggttggaatgtctgcagaaagtgaagccagagtagagatgaatttccaatgcccctggacacaggatggtgggcacagatgtcttcgtactagaaaagaatctcggaaggtgggattagtattagataaaaggcagacaggatgatggcttctttcgggagcatcctgatgcaaataagcactttctgggttctgtttcattccctagtttactttgctgggcacacacctggtttcatgagggctgtaaggtttctaggcttcattcttacctttctaggctgccgaggtgttagcagcattcctgcagcttggcattgctgtgacctgagagagagagagagagagagagagagagagagagagtataaacttgcagtgtggcagaggacttccttggccctcacaaggtcaaccaaaacctggctggttggtatttggatcaaaagggagtcggtctttgaagaaaagcattatctcaggataggaggtactgtgacaggcctgtgccagagttattggtccctgtttaaaaatgtactgacagtgtcacagctttagtaatttaataagtacatgtgtggttcacaggctgatctgaaacaagctggctgtgccagagtgggtcacacctggaccttgagtagtgtggatggcacacacaccatgagggttgggacagcctgaaccaaactgtggccgtgtgtttatggagtgctgctgacttcttagacatccacttatctctgcctgctgtgtttgagatgtggaaaatgtcaggtggcagcattcatgctgagaactgtccccctgggatttggactccctctttactcgctgccatccaggtctggaggtgatctcgagaaagaatatggggtgagctgtcctctgtaatcagatgggtgttcactttttccaggacaggcactggatctccgctcaacattctctggggctggaggggtacccttcacctcctgggtcaggaagctctttatgttgatagaaacatgtctcctcttgctacccgctcccccccccaccgtgtagagagcggacaaccccttggcatccttttcacagaacttctaagtctccataaatgtggggaccaagagcctttctgtggcctacaccacttccagttgtttaaaccctcctggtgtaactttttatttggagtttactcctgtgacattggtgtctctcttctctaactgtttgcacaaattgtccatagtgagccctttcatctcagttaagaatttcccacttaatctgatcacctactggcttggccactaactagctataggacctggccacaggttagtttcttggcctcttctttacctgtgaaatgggaacatatctgaaatacttcatggggttgacaggaggattgtgaagtgttgcatggaaagtgtttgtagtgcagtgtcttgcacagaggtagtactctgttaagtaggaggggagcttatcatccgtgtagccagtacgaggacctaggctggatgtctgtggacataaaaaagattttttgttatagtgtacacttatatcaatatagtcatattgatatatttatgtatggtctttgccttccagggaactagtaacctagtgagataggttgtctctaacttactgtaatccaagttgagcattgataagtaccataaatgaaaatagaaaaatggaccataaggctatagatgaacagttcattctggctgagagctggggtcagtttttgtgcatttatgagtcccaaaggcaagtgatttttttgggagggacagtcacttatactttggtggcccatggttagcaggacagcacttcccacctggaagtggcctctatctttggccacgttcttcagtttctgcatagaaatgacatttctttttctcccacctagtgcttaatttatgattgaaattcttgaagtatccagtgatgccctattcaggaggctgtccagccagtagcattcctttttattcgttgcctaatgcaacactgacagtagcgttcatttttctcttcctataagtatgtcaaagtctcttatcctaggtcctagttctcactgtcctaggtgagctttctcttcccactttgtgcagttagtatttttccacagacatagaagaagaaaagagcactcttgttttttggccccacccctctttggcacacactacttaggtgcttcaccccacacattggcccagagcttaagagaaggtcatctgactgtctggagctgtggaaactgcacatggcttttggcaagagaatcttgtggtgtgctataagtttttaagtttaagagtttacactctgcactggataatatggtaactaattccatgtgtggctacttaattaaaattaaataaaagtaacaattcagtttcttgattgcactaagccacatttcaagtgctccatagcccagttggatggcacagatatagaacacttctgtcattgcaaaaaattccatgggacagtgccggtctagggggttgccttatagttgtaggctactaataggaaagatagatgttcattcaggcttcagtggtttagattttcctcctgaatgacccaagttgaatgtctaagctttaaatctcatcaactaatgcaattaaaatattttaaccttcttaaatttgaatacaaaaagggtattcattttctgaagtcttttttgtgctgccgaattaccctgaagtagatagcaagtgtggattcttacaggtgaggaccttaatttgttttttattgtggtagaatatacataacataaaattcaccactttaaccattttaagtgtacaatttagtggcattaaatacattcacaatgttgtgtaaccattatcactatctgttttcagaactttctccatcatcccaaatacaacatatacccactaaataataacttccctttccacctccccccagtctactttctgtctccctgcatttgcctattctaggtacctcatataagtggaatcataaaaaatttatccaatgtactgactcatttcacttagcataatatcctcaaggttcattcgtgttgtatgtataagtagtatgtgtcagaatttcttttttttctttttttttttttttttttgagacaaggtcttgctctgtctcggagactggagtgcagtgatgtgatcatagttcactgcaacctcgaactcctgagctcaagtgatcctcccacctcagcctccccagtagctaggactattggcgtgcaccactgtgcctggctaattaaaaaaaaaaaaaaaaaaaggacagggtctccctatgttgcccaggctgatcttaactcctgaccttaagcaatcctcttgtcttagcctcccaaattgttgggattacaggtatgagccactgcacccagccagaatttcttttcttttcttttctttttttcttttttcctttttttttttttttttttttttttgaggaagagtcttgctctgttgcccaggctggagtgcagtggcacaatcttggcttacagcaacctccgtctcccggtatcaagtgattctcctgcctcggcctcccaagtagctgggattacaggtgcccaccaccatgcctggctaatttttttgtatttttagtagagatggggctttgccatgttggtcaggctggtcttggactcctgacctcaggtgatccacctgcctcagcctcccaaagtgctgagattacaggcgtgagcctctgcacccagacttcttttctttttaaggccaaataatatttctttgcatagatataccacattttgtttatccattcttttgttagtagacattggggttgcttcccccttttggctattgtgaataatgctgctgtgaacataggtgtgcatacatctatttgagtccctgcttcaattcttttggatatatacccaaaagtggaattactggatcatatagaaatgctatgtttgaccctgttttgtgccaggggagaagtggggagacagggtgggtcttgctctgttccccaggctgaagtgaactggtgcagtcgtagctcactgtagcctcacattcctgggcttaagttatcctcccacctcagcctccaaagtagctggaaaaacagtcacttgtcaccatactcagctaatttttaaattttttgtagagatgtggtctcactatgttgccaaggttggtctcgaattcctggcctcaaatgatcttcctgcctccacctcccaaagtgccgtgattacagacatgagccactgtgtgtggccttggccctgattgaaaaacaaacaaacaaacaaacaaacaaacaaaaccttaaaatcattgttgagatataactcacaataacataaatttcattcttgtaaagtgtacatacagcccagtcgttttaaatatattcacgaggtcatgcgatcatctccactagtcactgattttttttttttttagacagagtctcactctgttgcccaggctggaatgcagtggtatgatcttggctcactgcactgcctgggaaaacaggcgtgagctactgtgcccggcctagtcactgatttttatagcctcttaggactaaagggagagggagaatctagaaagtggcttgggtgcaaggaagggagctttcaggattatgtataatactcttaaaacaggatatttgttaatcctagcactttgcgaggccgaggcaagcagatcagttgaggtcaggagtttgagaccagcctggccaacatggtgaaatcccatctctactaaagatagaaaaattagctgggtgtggtggcacatgcctgtaatctcagctacttgggaggttgaggcaggagaattgcttgaacccaggaggcagaggttgcagtgagccaagatcgtgccactgcactccatcctgggcgacagagcaagactgtcaaaaaatatatatatatatacatatatatgtatatatatatatatatatatatatacatatatatatatatatatatatatacatatatatatatatatatatatatatatgtatgtattttttttattaccaattccttgaaacgtctcataatctttagcaacaatcctctgcccactgcgaggctttctgacctgaagtttagaaaggctcccctgctacctgacatattttcagctactcgtgaggccttgttttatggaacgggatgttgaagaacctcacaaatgggtcagactccccagcaatgctctggaagcctgcttctataggagcagacaggtgttcatgtgctataagctttgtcacatgcccttccctagcagggaactacttctgttccttctctggttctggtcctaaattctgaagctacttgcatttccaaacataaagcaagttgtttataataaatgccttaaatatttgattttcagattcatattgctctgctttggaacaaggaatacaactcctctgcttttgttattacaagccatttatacatataccagggtgctctggttttcacttgttctcatcctttagttgtggttttaatattttgtgctttggacatggttttattgtggttttcagatacatggccagttttcttttctttctttttttaatacgtcatacaattcacccctttaaagcgttcagttcagtggatttagcatattaagtcatgcaaccatcaccacaatcaattccagaatattttcatcaccacaaaaagaaatcccttacttgttttaccccaaccccctgccctaggccacccaactactaatctcagtctctatagatttttgaccagcgttcttgcattcttgtttaatggttattttttatttttatttttatttttttttgagatggagtctcactctgtcacccaggctggagtgcagtggcgcgatcatggctcgctacaacctctgcctcccgggttcaagcgattctcctgcctcagcctcctgagtagctccgactacaggtgcgtgccaccacgccaaactaatttttgtatttttagtagagacggggtttcaccatgttgaccaggcttgtcttggactcctgacctcaggtagtccttctgcctcagcctcccaaagtgctgggattacaggcgtgagccaccgcgcccaggctaatggtgactttcttcctctctaaattataatataagccaccacccttttttccgtctctgttccatttttgtcttttccccttccctccctcccctcttctgatattagcaggttagctctaaattctccttaattagctcccaaaccggatgaattggtggatgtggcacaactgcaggaattcatccaacaaaccagggatggacaaatagtgtgtttgagccctcgaacacccttccaagtcatctgccttcattctgtcactatgaggccagccttcttttcactggctgggaggctgtgggaactgcgagctaggccagcaagagagaactgggtggaagctggtctcagattgatcagtcacacagcctggggagcaatgaactgagatttcagtgtgtggcccatgtgagtgagtactgggacagaaatcaaatgcttgccttacaaatgtagtgtccagatgtataaattcagccactggatcctcctatcaacagaaacatttaatagtcaaattacagtttcaaaatcagtttacaaattacagtctgaaaatatcagtatttaacttgagaagcactgttactcgtacctggtacagagtcagaactcagtgaaacttcccctttgccctctgaagttttgctgaaaagtgaactcacaaaagacagattaattagagaaaaggcatacacattttattcacgtttatacagggagaaccatgagtgactacctacctccaacagggttcagaggctttatataccatcctggcaaaataagttataagacgggggaagaagaggaattctgttgagaggatcactagggagaataagtggacaagataacttgtatactatcttgtgaacgggtctttcaggtgtggttacattcctggtcttacaaggaggggaagaaaaaaataaatgttccttttggtgggtctggactttaggcacataaaggaacttcaacttcgtcctgctttgggagagacattggtagggggaggagggggaaggtcagagagaccttgaggcttcttcagttcagtacgtcaaagtgccatattttgggatatctgcttctgagccccaacactgttattaagaggccatattttattgtaagcctactgtatacaaggcacaggttaggttttgtgaaaaataagccaaagcttcttgaatggaattcaagccctatttatgttataatgtgcaggagtttagcaggttaacactggggaagcagagacttggtagcatccacattttgcttgtttctttagaaccatatattttattaaataaatttttataaaacaatgtgttaactgtagataccctcaacacaggaaaggtttggttaagcttagattcttgctgggaattgtagatattataatttcttgtggataatttaaaaaatttatcatttactattggccactggtagctttattcaaggcaaaccatcttgctcaaaacaaataaccttgaccaaaaaggtagccaggatcctatttagtctatctacagattgtttttggttaaaaagacatcagtgtttgttccatgccatatatgtatctcctgtttcattacatctccgtattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaccatgcctggctaatttttgtatttttagttgagaagagatttcaccatgttggccaggctggtcttgaacttatgacctcaggtgatccacccatctcggcctcccaaagtgctgggattacaggcgtgagccaccacacccagccaatactagttttttttattgctaaagagtgttctgggccgggcacggtggctcactcctacaatcccagcactttgggaggcagagacaggtggatcacctgaagtcaggagtttgagaccagcctggccaacatggtgaaaccccatctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaaaaaaaaaaaaaaaagagtgttccactcacagtgaatataccacagtgtttttgctccattgctgttttatccattctttctttcttttttttttgtctaagatgaggtctcactctgtcacccagactggagtgccgtggctctacctgggctcattgtaatcttcgcctcccaggctcaagcagtcccacctcagccttctgagtagctgggaccatagtcacgtgccaccatgcctggctaagttttatccattctcttgctgatggatagttggactatttccggctttgagcaataatggataaagatgctgtgaacatgcatgtgcaaaccaccttgtggtcctgtgtttgctttatttctcttgggtaaatccctcagggcgggattgctgggtcatatgtatgttttaactgtggaaagaactgccaaatcttttcccaagtggttgtattcttttacaccctcacctgaagtgtatgaaagttctaactgctttgcacctttgccagtacttgctatagtcaatttttttgtgggatttaaattttttttgccattccagtatgtgtataatggtatgggtttctcattggttttaccttgcatttccctgatgattaaagatgttcaatattttttcatgtgttgattaccatgtgaagtgtttgttcacatttttttttttttttttttttttgagacagagtctcactctgtcgcccaggctggagtgcagacagggtttcgctatgttggccaggctggtctcgaactcctgacctcgtgatttgcttgccttggcctcccaaaagttctggaattacatgcgtgagccaccatgcccggccggattcggcaactaatttgtacatcttaaagctcctacaagtttatgacacattattatatggcagaaatagactaaaaataactttctgtgcaaaaatagttctggaagtcgtgtcacagggctcttggcccagcagggagccacttttaactagagctaaaagccagcattgtaaatagcatagaattgactgtaaagaggcaaaagggaatgttttgggatgatggaagtgttctaaaacttgattatgggggtagctgcaaggctatataaattcacagtggtcacttaaaatgggtgaactttacagtatgtaagttacacctcaagaaaactatagtaggaagaaagggagaagggggaacgagggaggagaggaaaggaaaaggaatagaaaagcaagcacaaatataggagggcattgttttgtaaaaacccatttcagctacagaaatatgtacattgtaaatatgtatttctaattgtggagttattaatgatctaaaacgttggaaagctcctgctccaagggaatgacatctagggcagtgctttgcaaacttgatgggaatcccctggggatcttcttataatgcatttcatattcaataggtctggggcagggactcagagtccacattttgaacaagtttcagctcatgctgacattgctggtctgtggacctcacttctgagtagcaaggactagggcataaattgaggctgagctattgagaatacacaaacttaatactgtcattgttggaagggtctttagaaaaatctagtacaatatttcccaaatggacatcatcatgagaaccttctaggggtacttattaaaaacacagattcctataatcaagacagtgtgatactggcataaggatagacaaacatatcaatagaagagactgcagagtccatatatgagtaattgaatatttgacaaaggtatcaagataatttaatggaaaaagaacagtcttttcagcaaatggtgctggaacaactgaatatccatatgcaaaaaatgacccgtgattgataccttgcatcatatataaaaattaactccaaaatagagctaaacctaaagccataaaacttctagaagaaaatacaggagaggccgagcacggtggctcacacctgtaaccctagcactgggagaccaaggcgggcaaatcacttgaggtcaggagttcgagaccagcctggccaacatggtgaaaccctgtctctactgaaaatacaaaaattagccagaaattgcttgaacccgagaggtggaggttgcagtgagccgagatcgtgccactgcactccagcctgggcaacagagcgagactctgcctcaaaaaaaaagaaagaaaagagaacacaggagaaaaccttcatcaccttgggataggcaaggacttcttagaacacaagaagctcaaattataaaagaaaaaaattgataaatcaaaccatcaaaaattaaatcttcttttcttcaaaagacaccattaaaattaaaaggcaaataagatgaggagaaaatattcacaataaaaatgtcagacaaagaactgtgtccaggctgggtgtggtaactcacacctgtaatcccaacactttgggaggctgaggtgggaggattgcttgagcccgggagtttgagaccagccagggcaagatggtaggaccctgtctctgcaaaaaaaaaaaaaaaaaaaaaaaaaaaaaaaaaaaaactgaaaattagctgggtgtggtggggtacacctgtagtcccagttaccagggaggctgagccagtaggatcccttgagcccaggaatttcaggtgacagtgagctatgatgatgtcatggcacactccagcctgggacacagagcgagactccgtctcaaaaaaaaaaaaaaagaaaactattgaccaaccttcttgtgaataaaatataagcaaataaaaacatcttgcagctcagcaagtaaccccaaaaatgtgcagatgtgaacagaggctgggcacagctcacacctgtaatcccagcactttgggaggccaatgcaggcagatcacttgaggtcagaagttcgaggccagcctggccaacatggtaaaaccctgtctctacaaaaaaatacaaaaaaaaaaaaaaattagccggacgtgatggtatgcacctgtaatcccaactattcaggaggctgaggcaggagaattgcgtgaacctgggaggcagaggttgcagtgacccgagatagcgccattgcactccagtccagtgacagtgtgagactccgtctcaaaaaaaaaaaaaaaaaaaaaaaaaaaaagaaaagaaattagttgctggatccataagttaaaagaattttgaccttcttaaactccccagttgacttgtgacatgtttttaagcctggacctgctatttgcttgtgtgttagaccatgatggttagcagagaggtaaaatgattttaaatattttactaagtaatagtcacatgtgtctgaaatactgtaatttctgaaaataaggctagatttgtgaagttttattgccaagacaggctctgaaaatctttccttaaatgaattagaagcccagagttgaatatgttgttttagtctgtttgtgttgctataaaataatgcccgaggctgggtaatttataaagagaagaggtttatttggctcatgattctgcagactgcaagaagcatctgcttctagtgagggcctcaggctacttccactcatggtggaaggggaaggggagttagcatgtgcacagaccacatgcagagatagaggaagagagagggaggaaaggcatgtgctgggctcttttttacatccagctctggagggactctcatgggaactaacagagcaagaactctcattaccacgagcatagcaccaaaccctcatgacccaaactcctcccacctggctttaccaccaatcttggggatgaaatgtcaacgtcagttatccagactatagcatatgtgttacaggtttctgttgtgaagtgaaatatattttcctttgtaaatcatgcctttaagacaaggccttgcctttcacctctaggcaactgtcactccccccaccaatgtgttattctggagtcagactgcctgagtttgcaatgcacctctgccacttaaccagttctgtgacctcaggaaagtgtcttaatgtctcagtttccccacctggaaaatgggtacaataatagtacttactgcatagatttgttaggataatcaaataagtgtagacatgtaaagtatttagggaggctgaggcaggagaattgcttgaacccaggaggcggaggttgcagtgagctgagatagcgccactgcactccagcctgggcaacagagcgagactgtctcagaaaaaaacaaaacaaaacaaaacaaaaaaacagcatttaggactgtgcccgacatgatcaatgttgattattatcatcatcattattattgctatcctcattatcattatttctctaaactggctgttgtcgaaatctcttattaagctattttccatgcctcccaaattctttaacaactaaacttatggcttttcccccaagtctcctgaggctgcttcctatttctgcacatttccgcatacgatgccaaccactgttctcctggcttcctgggccgaaaacttcagatctcctttgactctctcctccccacctccattcagttgcctatatgtgtagtgtctaccttttcatactagaattatcctttcctttccattcagattctaatcacctctcatctggattattcatttatcgtgtagctgaaatgggaccgtgtagctgaaatgggaccgtgtagctgaaatgggaggacagggttcccgtgggcccagccctggacccacctgtgtgggataggggacaggagcagctgggaagacaggattgggtgcgggacatggacatcagcagtgtgagggacaggataaggaaaggacagtgagaaggcggctctgagaaggaccggccacaccttagggcctgcctgtatttgaaatgcctttattagcttttgcatattcctcacagacatctctttgcatacaatgaaggtctttgggtgaattggatgaaatggcttgttaccagcttgaatgatcacttagaaaaaaactgcgcaggcctgcacggtggctcacacctgtaatcccagcactttgggaggctgaggcaggtggatcacttgaggtcaggagttcgagaccagcctggccaacatggtgaaaccccatgtctactaaaaatagaaaaattagctgggcatgttggcggatgcctgtaatcccagctacttgggaggctgaggcaggagaatcacttgaacctgggaggtggaggttgcagtgagccaagattgcaccactgcactccatcctgggcagcagagtgaggctttgtcacaaaaaaagaaaaaagaaaaaaacttgagaaaacattttaccctgttccttctctttatctttgtttcttacatttagtgaccatattggctatgtattgtgtgcatacaaccatcacgccctgtccttagcagagaactccaattttgaaacctcagaaggtggatactgtgctcgatgaaagtactcagtgccatattgatgagcggaatgttgggttaccttgggaacacagacgtccttccttgttactataaaaagggccacagtggctgtggttgtaaggcaacctacattttactgattctttatggtaaaaacgtgcctgtagggaaatgctgtatttttttaagaactttgatcagatacatcagacttccttttagtgctgatcaaatcaggtaaacccagttttcagtacttacgggtttttacaagtatcaaagctgtttccatccatccttcttctcctctttcctgtgcccacagtaagtaggcaggatatttgttgtaagactcaatatgaattgttttcaccaacagggattatgactaagagtataatttatactaatgtccttaggaggggacttatttgcctggtagggcctgtataggtcatatgaaggcagatggcgtgtgtttgacctcctcagggtggcctgttgagcagggttgcctggccaagtaagccttcccactccagattgtgaggcagctcaatgtgtttgcctcgcttgcaggttcctaccatggtttcactgtactgccatctgggaaaggaaggttggtgcagtttattccataataattaaaagccttaccactactaataaggcgtttagatacagccctactggccgggtgtggtagcttacacctgtaatcccagcactttgagaggctgaggcaggtagatagatcacttgaggtcaggagttcgagaccagcctggccaacatgtcaaaaccccatctctattaaaaattcaaaaattagctgggcgtggtggtgcgcacctgtaatcccagctactcgataggctgaggcaggagaattgcttgaaccagggaggcggaggttgcagtgagccgagattgtgccagtgcactccagcctgggcagtagagtgagactctgtctcaaaaagaaagaaagagagagagagagggagggagggagggaacaggaaggaagggagggagggtacagtcctacctaggggaacaaattatgcccattgatgctgtcaaacacctatcagaagtttactaattctctgcgattgaagaattattttattattgctaccatttttaacaaagccacccaaatgggaatcgtgtttattttctttatcgttttctgaggttttatattactaccgtatattgatgtggcatgaaccaaggtgtatacactgtgaagaaggtttttttattcgtcacatgcagtgtagcttactacagcaggcttccttacccttggcactactcacttttggggctggatgattctttttttttttttttttgtgagtcttgctctgttgaccaggcgggggtgcagcgatgcggtctcagctcactggaacctccgcctcccgggttcaagtgattctcctgcctcacactcccgagtagctgggattacaggcgcgtgtcaccacacctggctaatttttgtatttttggtagagacagagtttcaccatgttggccaggctggtctcgtacccctgacctcaagtgatccactcgtctcagcctcccaaagtgttgggattacaggcctgagccaagggctggatgattcttgtttgaggctgagggttgtcctgtgcactgtagaatgtttagcagcatccctgacctgtacccactagatgccagtagcacctccccaggagatattttggagtctcaaaatatctccagactttgccaagcactggggtacacagtctcccctggttgagaaccacagtattagaatgtaaggattgtgtagcttgctatttttaaaggcagtggtcatctgaagcactagttttcggtcagctataatagaaatgtatgtattgacctttaagtatgacagtttggctaacttaaaataatgtggtaaatccaaaacccgattgctgtgatgtgctagcatgcttaaatagcaacagcatattgctgttctttgatgatcgtttttacagatgaatggcaacacacaggatttgaaaatgcatatatcatttatttttatgttcctgaaatgaaaaggaaagaaatagtgacagccacaacagcccaggtaccatccatactcaggcatacctgtagtgcacatgggaaaagcacttttcctatgtgttattttggaatggcagtggccttttctgtggaatggccaaaagagaagcttgtacatgtccataaaccttgggaattctcccctgaaggcctcgttgttttacttttcacaaatctttcccagaaccaaatattcagttccacggtttaccttttcttttgtatcataatctgtagttttactattttcaaaatcaacttttaactactggcagcaataaattgaactttaagattcatggttcttttgttttccaaagagggttttagcagggatgcggttagaggctggaggtgggttagatagaggtaaatttaattgacaagctagagataactgcgaggctgtttaaaaggccaaccagactgccctgaacaatgttgaatgcggttacacattgtactctgcttttgtggtttaaaaataatctatctgtggccgggcgcagtggctcacgcctgtaatcccagcactttgggaggccaaggtgggcagatcacaaggtcaggagttcgagaccagtctggtcaatataatgaaaccccgtctctactaaaaatacaaaacattagccgggtgtggtggtgtgcacctgtaatcccagctacttgggaggctgaggcaggagaatggcatgaacccaggaggcggaggttgcagtgagccgagatcgcgccattgcactgcagccccgacaacagtgcgagactccgtctcaaaaaaaatacaaaaataataatctatttgtgccatgaagctgtttcctcaaggcctcaaagtgcccttgaagattgtccttgtttaagaattatgttgtggctggactgaggatgccagacgcacagatctgtaggcctaggatgggggtaactctgctgggcatgtttttcagagacaaatggaaatggaacaggggttctaactttcaaaatcatttttaacctgtctcccaattgttgtaataccaagagttttactctctaattaaaaaaatattttttgtagagacagggtcttggtatgttgcccaggctggtcttgaactcctggcctcaaacgatgctcccactttcttcctaagcactgggaatacaggcatgagccactgctcccagcccaaaagagtgattttttttcctagcccctttatttatcctttgcattttgttttaaaactaaggaatcttcttgaaacggaagccagctggtggtaggagcaggcctaagcactaccctgatgacttgcattgctcttcagtagccttgtcagtggcctctggactcagtggtgtaactgggaccatctcttctgtgggctggaattgccatgagctaagttggaatagcagggctaggagagcaagcagttcacattgggtagtttgtgctcagcagtgattaaagctcagatctgggccgggcgcggtgggttatgcctgtaatcccagtactttgggagtctgaggcgggctgatcacctaaggtcagaagtttgagaccagcctggccaacatggtgaaacttcgcctctactaaaaatacaaaaagctgagcgtggtggtgcacacctgtaatcccagctactcaggaggctgaagcacaagaatcccttgatcccaggaggcagaggttacagtgagctaggatcgtgccactgcattccagcctaggcgaccgagtgagactctgtctcaaaaaaaaaaaaaaaatcagatctgatgcccagtgagatggccaaggaagagttgtcagcctaggaagaaggggctgtcctcagggaaggggtctgaagggtcctgttaaccctgtaacagtgaggttggagggaccccaaacaaccacatacatgtaattgtgcagaaacagaaacaaggaatgaggacaatataatcagcttgagacaaagagcttgcagttggcttgctcatactcaagagtgcagcttgtcctatggtagggacctggggccttatgggcatctgggccaggagtgccatggagattggctggaaaggtctctggtgagcctttgggatccttttttctttctttttctttttagctatctccctataggaaggatgagactcttttacatcttttactttcatgttattaaacacacatacacatcaccatgaatagaaatcaaatgacattgctaatactggaaactccacaggtaatttctctttaccagtcattacctgctgggttctgtccacagtttaaaagagatatttgtacatttcttgtgctttgttgctgagaaaaagcaacaagcttctaagcaagagtcatttatccccgtgtcttggccctctttccagaagctcaaagcctttctgagtcttgtcttggattggtgagttgggagcttgtattttcacatgacacaaccctcattgagcaaccgcttctcctgatatgtaacctgaaagccagcctctgccccaccattacaggaaaatactggctgggttaggctgaggaataatgatgcctgacatttattgagcagtgcttgtgtagcgcatagtgtactgagcagttccctcttttccctcctcctgtttgcatcctttccctctcaattaatgctcctagtgatccagtgagtgggcgcgatctccatggggttagaacccaggctacctggctctggagcccctgctcccagggcactgtactcagctgccctctctgtacttgctgggggatgtgggggtgctcttcaagggtcattttgtctgcatgattggagccctttatcaggtgagactccagaagctcacgcaaaagccctgcatgtcagagcctctccatctctaaaggacctgaggccaagttcagatgcccagacctacatgccctgtccatggtagaaaactctacccttgctgccctgtccatgtttactgccttatctcattctagccccatttgcttgttggttttttgggatcaccttgtatagggtgggtagaatccacattcttgttgttgaagaacaggcatgcacaaaaaactgtgatgaacagaattacacagaaaggagagcatgaaggtggaggagagatgatcttgcaaccaccgcacagggaagaaggctgggaggacagacctcagcatagagtcacccgtattaccttagggagccctgagcttagctgtataggtttcttttaactagcaaatcatgctgtgaatagaatatgctgtgcatattggcttattttgaaattacatataattgtagaaacacaggaagctaggtaattcctgcctcccagatgaggatccagggtgggagctaagctttcatatcatggtgcccggtagataatcagttgagtttaatttttctagactatgtcttccttcgctacctttgagtttgctcatcttagcttctaagcaaactatcagcttggcagagaaagccttagaatgaaaactgtgacctcttaggaagttgtggggggtttcctggagtagttttatggggttcttgggaagactgaaatgattccaggatttggggcccagtggtcatctgccccaacttgttttgtctgtgttctcttctatcatcaggggaaaggagccaactgtgaatactcctgcatgccaagcattttcaaaaggtcttgcctctaccccataaccttgggatgtaggtagtaatgttcctattttatagaagaggaatttaaacctctgagatgttaaggaatttacccagtctcttgactaggatacagttgggcaggccacatggatggagccaagaagaagctctcagggccgagggggctgagctttatctatgaatggggagaaaatccaattgaggcagttttactgtagctgtagaaagaaccaggcctttggggcatttgtagctgggatctgatgtagactggagacagttaaaagcatgagaaagtcaggttaacagttaccctggaagataacagctgtcaaggaagagttcaggaccaacgaaccagcttcttagatttccttatcttctggtaaccagcaaggttaggcctttttgccatgctctttctcttcagccactgcctgggcctttgcaggtgacttcagttcccatgctggccctggcagaaggcatacctcctatttcccatgctgcccttggagtccaaatacaccccacttcttcacagggccacagtgaagatgtggttacctgggagttgccgggttattcttcatagctttgggcactaacaacatatggcaggtggtcagcactgaattttgccttttctgtttgttgctgtagttgttacagctttgaaaataggtataaattacatacactacaatgcacaaattttaagtctactgtttgatgagttttggcaaatatgtacactctcggggcctagcctacccaatgggtcccccactggaggcttggggcaagctgaagacattgctgatgtgaaaacaaggattaaagatcagggagggtcaggggctggttctagactgtggtagtagacatggtggtggtcaggtaatgagattaaggaatactcatgctttctggatactcaggacatatctcatttcagggccatatctaaaccagtaataatgatgataatactgttagctaatatttattaggcatttaatatgttctaagagctttgcatatattgttccttaagctccacattactctgtaacacaggtgctgtttaacagctgagaaaagtgaggctgagaagcttccccagaagtcacacttagtgtgtgctgagcagggatttaactgagctgggcagagcccactcctctttcttagcatcatccttcgtgcttcccagtaggaatagctaccattttctagatatctaggtctctctgtcagtgctccttccctttaggccctctcattattgagagtcaaccagactggcctcaaattcatgctttgctacttaatagctgtgtgactttggacagatttcttaacctctctgagtctcaatttcctcatctataaaatgggggtgcctcccacctcctaggagtattgtgagcattaaataatatttgtagagaataatgcctggccagaagtaggtgcttaggaactcatatttttagaaaaagacaatctagcccacaaatacgtgtacagtcctcaaaactaggcactgttgaattttataacttggcatgttgtcttttggttctggggagcttatttaccagattgagttactggcgcaggagttcctggggtggctgagtacatgtgtatgaatatagaataacatcatcatataccaccttcataattagtgtttgtgagatgtcatctctacgtactttttaaataagaaattacttattttgctgaagacaggatctctcatttctaccataaagggcgtgtgtctacatgtgtagacaaaaacaagcaaacaaacagtgattggtaactgatatactctttgcagaagatgagaaatgaagaggacatatacatgtttctagtataatttttgttggaaaagaatccttgccctagttttacactggcagtgttgtaatgtactctatcttatcacccccattaggaaaggtagcctgattgaggtttccaggtgtgtgtgcagaggccctccatagtggaaggtggagaacaataaataggagcatgtgcattagaatagccaacgcagaatagctggatttgttgagctcctattgtgtgctggatacagttaagcagtgcctatatctcatttaattctcactctatgataggttctactcttatctccattttatagaagaggaagcttagagcaggtcctgcggaactttcctgttttttttgttgttgtcgttgttgtttttttagacagagtcttattctgatgcccagggtggagtgcaatggtgcaactttggctcacggcaacctccacctcccaggttcaagcaattctcgtgcctcagcctctcgagtagctggtactatgtttatgccaccacacctggctaatttttatatttttagtagagacggggttttgccatgttagccaggctggtctcaaactcctgacctcaggtgatctgcccacctcggcctcccaaagtgctgggattacaggcgtgagtcactgtgcgcggctagaactcctgttgtaccttcttctgataaccgtgtgtagaggattttgtggcagaatggtgatgattacatgccaagttttggagtcgggggtcaggggagggatccattctcattattattatttgaccttgatgtcaaagtactatgcactttgtattgtttgggcttcgcccaattctacatttggtggggaaaatggcccttctcttagctgtgcaattgtgatttaagaaaatcatttaggaatcatttgaattgtttagtaataatcttacatgtctgcatttttctggaaaatgtaattcagttagctgttttaaaaggaaacctatgggaatttagtgggcatattttataaaaatctattaacggcgtagatttgtatatagtcttaaagtagttccctatttctccacttctttcttttcaaggactttttggcatctgtatacaatttttttttttttttgagactaagttttgctcttgttgcccaggctagagtgcagtggcgtgatcttggctcactgcaacctccacctcctgggttcaagagattctcctgcctcagcctcccaagtagctgggattacggtgcacgccaccacgcctaatttttgtatttttagtagagacggggttttgtcatgttggccgggctggtctcgaactcctgacctcaagtgatccacccgcctcagcctcccaaagtgctgggattacaggcatgagccactgcgcccggcctgtatacattttttaattgtctataccttttggatgtctataccttcatcctagtagtcagtagttattgaacttaattcctagttctagacttgcctcattcaaaagtatgaatcatgacatctttgaaaggggcacgttgcaaggaatgaattgggtgataatagtgacttattatcaccatttaagagaaaatttaagccagttcagaaaattatagcaggtaggaaatggattagatcattcattgtcagagcgtggtccctagactagcagcatcagcatcatctgggaatttattagaaatacaaattctcaggccccaccccagacctactaactcagaaattctaggggtagagcccagcaatcagtttttaataagccctctaatggattctgatgcacacgaaagcttgagaatcattggattagaaccctcccccacccaaaaaaatgctcggaagagttattaagctattgcaagaaatggcatcttcctgagagacaaatttaagttgaaaccacctggttctgctcttgtcagagatagaaaatggaataaatggccactgataggtctttgtaaccatatgattcccctgaggttagttcctgcctaggtatttgtttccaaaataagtatcccaaataaataccagaacttcatgtaatagtcgaagaaatagaattcagtagtcaaaagggattaaaagcaatttgtacatttactggagactagaaaagtgtcaaaagatgaattcctaatatgcagctttttgcctcgtcctctggctcccagtattatttgtgcacacacacactgacacacccacacactgtaccttccaagagtcacacaaaacccttccctcactcaattcctagtcagaactctccccagaaacagtccaacatggctcatggcttcctagtccctcatctctctttcacttccttctctcttttattccccccatcccccacccccatgcagcatatttttcccctttccagtgtcgattaatgaaaactgattcatttctcacagtcctggaaatctacccacatacattctccatctgtgtaatgaaagcccaataactgattcatattggatgggtagaatggaaaaagccaagaacataaagacagagttctctttctggtggagagagagatggagcagtctcatctctggttgaatggggcctcagagctgttccacctgaaatttcatgatttgggattttgaaagtgccaatcatacattaaattgactttttagggttttctttttttgcacattgtatgctggtatgattaaaccttcattttaacactgtttttgtttgtttgtttgtttgttttgagatggagtctcattctgtcacccaggctagagtgcagtggcacgatcttggctcactgtaacctccacctcccaggttcaagtgattctcctgcctcagcctcctgagtagcagggactacaggcacacaccaccacacccagctaattttttgtatttttttgtagtgacggggtttcaccatgttggccaggcttgtcttgaactcctgacctcaggtgattcacctgtctcagcctcccaaagtgccgggattacaggagtaaaccaccgcgcctggcctcattttaacactgttaagggttgttttgttgatgttctcagagtgcctttaatggttatgaatttcattttgaagaaaaattaggttgctacacaatttcgctgttggttttcatcaaaagtccattgtattaaagcactcatcctgagttatggagagaattgagatttagccctacactgaaagaaatttaaatgggaagtttagtgaccttatgggattgtaattggttttgaggttttaaatgaaaaatatgaggcgggagtatgtgatgctttccgaacaaaaacaatataccctcatgcaataatgaaaaaggttctagattctgtcagttgattttcagtttccacttgcaagattgaaaagttcaattggatttcaggctttattattttctagcatatttttgcataaatcattacccttgcctggaatttccaactcctgcctttcactgatctgaatctgaccccacctcctctctcccaggagagcagcagagtccagaagaaatcacactggattaaaagtcagagagataattagactcctcccacttaataggacattggatgggtgggtcacttgatgttttaaagtctccatttctttcttttttttttttttttgagacggagtttcactctcgttgcccaggctggagtgcaatggcgcagtcatggctcaccgcagcctccgcctcccagattcaagtgattctcctgcctcagcctcccaagtagctgggattacaggcatgtgccaccatgcccggctaatttttctatttttagtagatggggtttctccatgttggtcaggttggtctcgaactccagacctcaggtgatccgcccgcctcggcctctcaaagtgctgggattacaggcgtgagccaccgcgcccggccggtgggttattttctagattaaagaaatgggccgggtgcagtggctcacgcctgtaatcccagcactttaggaggctgaggcaggcggatcacgaggtcaggagatcgagactatcctggctaacacggtgaaaccccatctctactaaaacaaaaaattagccaggcgtggtggcgggcatctgtagtcccagctactcaggaggctgaggcaggagaatggtgtgaacctgggaggtggagcttgcagtaagccaagattgtgccactgcactccagcctgggtgacagagcgagactccatctcaaaaaaaaaaaaaaagaaaagaaaagaacccctctaaaaataatggccagcaacatttaatgagcatttattatacgggaagttcttcccacacatttcatgtaaccatcacagcagctgtttatcacaacacatttatcatttattggcagtttttttcatccccttttaaaaataaacactcatttttcttccaacttgctaacatttatttttgctccccagttttacaaagtataattaataacaaagctgttgggattgtgtgacaaagatactttatagaaatatatatgatttttacatactcacatgtaccacataggtttgcctttggaaccagatatatcatctagatatttgggatgaaaaggaaaaacaggcaacctagaagatttgggagaaggccgcagataagatcaactaggctctggattttaagccttgttgtggaacactccctgatgtggtttttggtattttgctttttttggggtgggggggagcactacaaattcttttattgcaatataatttactaataataacattaatcattttgaagtgtaatctggtggcattttgtacattcgcaatgttgtgaaactgtcaccactgcctaaaataccatcacattttcatcactcccaaaagaaatcttgaacccattagtagtgtttcacaatgtctcccatccccttcattccttttttatggctgaacattatttcattgtatggatgtataacgccatattatatttatccagtgtgatggttaatttttagtgtcaacttgactggattggggaatacctagagagctggtaaagcattatttttgtgtgtgtctgtgagagtgttttcagaggaaattggtgtgtgagtctgagtggactaggtgggggaagatccaccctcaacgtgggtgggatcctccaatcccctggaggccaagacagaacaaaaactgaggtgctcagtatatgttactgcttccccttcatgaacttgacatttcttgagtgcttactgtgcacaaaacactgtgctaggccctttgggggctacaagaagaaatggaacatagccctgcccttaagaagcttgtatcctgatggatggactggaaagggagggttggcgagagagggcatcgggagggtagagtttcctgtgcctgagggtggtgaatgagagagggaaggacccgaatgtgaagtaaagaggaaaaaggtctgtgagaatcagagcactgatggaattcaatggaaagattaatctgtgtgtgtgttgggggtggggctatggggagcagctcatggagtgccttcctttctttacccttgtattcctcccacaactctagcagaaaaatgggtacaaagatgccttaaaatgttggttgtttttatagacacttctggtatgaggttaaaatattctgcaaattgggaggtttccatcaatgggacataatattcgtggccctttgattcagcaactttttgagtccctcccagtctttagggtgccagagattcagagataagacaagagtttagaggacaagggtcaaatgaaaagacccaaagcctggcagggtggtgcacacctgtaatcacagcgactggagaggctgaggcaggaggattgcttgaggccaggagttaaagatcaaccaggggcagcatagtaagacccagtccccctgcccctgccttccacctccacggaaaacaaaacaaaacaaaacaaaacaaacagacctagacagtagcatgtaggacagtaacaaccttggcaaaggtaaacactgtggaggaatgtggcaggtgatcagtcattccttctgcagactgttttggggctcactctgctgagctctgtcatacagagagtagccacagggagggccctgccctgtagaatcaccataatctagaacactggttctcaaggtgtgggccctggaccagtagtgtcagcctcacctggaagcttgttagaaaggcagattctctggctcaccccagacttactccatcagaagttctggaggtgatgtccagcagtcattttcacaagccctccaggtggttctgatgcatgctcaagtgtggtgagcagtgggctaggacagttgtcaggtctggatgcacattagaatcacacgcggggcttttaaagcaacagtgcctaaaccacacctaagactgactagatcagaatctgaagggagacccaggcatctatatttttgaaagctctccaggtgattccattgtatagccaaagttgagaagcggtggtctccacatgcttaaacagatcatcacagtgcaaccaagagtgaccattaaggtgggaaacagtgcctgtgagtccacagagcagaggatgcctggcaaccccttgaagggatcaggatggctccccagaggaggtgaggacccttcattgtatttcctattggatgagctcttcattcctccttccctttttttctggacattgcagttgcacaaatctgagtgtgatcggaaaggttattttaaaattcatttaatgtgattaatttttcaaagttgaacacagctggcttccctttaaaactttgtattttgatagtggttcttaccatgaataattgactaatatcaggtcattaatattctataggagagtacttcaagctaataaaattcattttaaaattagtttttaaaaatgtgttcctgcagcccagggatagtaggatctcagtcaagtatgagattttatgcttttctgttaacataagatagttgtttgactgctcagtatccctgttttattccaatttttttgtaggaattaattgcccaggaaaagacctctgtttcagagttgcaagtttgcctggatgctgttgccctgggaaacattattgcatcaacagtggggaaggggtggctctgacatgggtgctctttgtccttctcctgggtagggcatctctgagagggtatcccctttaggtccttcccagggcttcacatttgggccagatttttttaaaaaataattaaacttttgtattttgaggtcattgtcaatccacacgcagctataagaaatattataggctgggtgcagtggctaatgcctgtaatcccaacattttgggaggctgaggcaggaggaccacttgaggccaggagttcaagatcagcctgggcaacatagtgagactgcatctctacaaataaataaataaataaataaataaataaataaataaataagaaaaaaattgccgaggccaggcgcggtggctcatgcctttaatcccagcactttgggaggccgaggtgggcagattacgaggtcaggagtttgagactagcttgaccaacatggtgaaaccccgtctctactaaaaatacaaaagttaaccaggcgtggtggcgcatgcctataatcccagctcctcaggaggctgaggcaggacaatcgcttgagcccgggaggcggaggttgcagtgagccaagatcgcaccactgcactccagcctgggcaacagagcgagactccgtctcaaaaagaaaaaagagaaagaaaagaaaaagccaagcatggtgacacatgcctgtagtcccagctacatgggaggctgaggtgagaggattgcttgggcccaggagttcgaggctgcagtgagctgattgtgccactgcactccagcctgggtgacagagtgaaaccctgtctcaaaaaaaaaaaaaaaaaaattacagagagagcccatgtaccctttacctggtttcccccagtggtagtatcctacaaaactatagaacagtatcacaactaaaatgttaccactgatacaatcaagacagagtacatttcatgatgccttttatagacatccacttccctcccacccctaccctctcaacccctggcaagcatgtaggcatggatctgttctccataagttcttatggagttcaaaggtaaaactgggtccctggttttaaaaaaagaaagagatggccatagactgtggctcatgcctgtaatctcagcactttaggaggctgaggcaggaagattgctttagcctaggagttccaacatcagcctgggcaacatagggagaccttgtctctactgaaaaataaaaaaattagccaggcatggtggcacatacctgtggttccagctacgtgggaggctgaggtgggaggatcacttaagcccaagagttggaggctgcagtgagcaatgatcgtgccactgtactccagtttgggcaaccaacagagtgatatcctgtctcaaaaagataaaaaaaagatgataaatgcacacaaatagggcacatggacaaaggatgattgggtaggaaagttagacattttaggatttcaggccatacataaagactttcttttggaactgaattcagcactgtattagtctattttcacactgctgataaagacatatccaagactgggaagaaaaggaggtttaattggacttagagttccaaatggctggggaggcctcagaatcatggagggaggcgaaaggcatttcttacatggcagcggcaagagaaaatgaggaagatgcaaacgcagaaataaaatcatcagatctcgtgagacttattcactaccatgagaacagtatggggaatactgcccccatgattgaaattatctcccaccagttccctcccacaacacctgggaattatgggagtacaattcaagatgagatttgggtggggacacagagccaaaccatatcaagcattacttcttggatacactgtgtctttagagggcatctcctggtgttagtgttcacagtaatctacctcaattcctctggtttaaatctggctgtgttttggtaataactggtttatttgttagaggccatggtttgtgctccagccctccttacctcggaatgagctcaagggctttttgacagcctttgggagaaacatgtagagtcagaaggtggaagctggagatgagttaatttggcttctcttggaatggatattctcaaaatgtttgctcaacaattaagcagaagaagcagatgctgtgtggaagaagctttactcatccagtaaatctcaatcccgactgaactcagacttccttatccacatgtgccccagagcagctagacgtgcagagagagaatcacaggagggagctgccaggcttctcactgcagggtggtaaccgccagccacatgtggctattaagcgcctaaagtgtgcccagtgtgactaaagaactgaactgtaactgtacttaattttgatatgaaatttaaatagccatgtatagctcatggctaccaaatgaacacagagattccacattgcccatgttgggctgtttgagtcactccacccctttcagtgggataaaactgaatttaaaaaagaaagagacggccatgcattgtggcatgagcaaggagaggccttacagcttcccccagggtcctctgtaaccccttccccacccagcatcagccctaaaacattgctgagcaaacattttcaaaccactagtgtgaggaggaagctgctaattagcctgcctggacaggagccacatctgtgtccagctgggccagcgcttggctcacagtactgcttacttcatactgctctaatgagtcacacttgacttctctttagatttgcaagctcattcttggggccaggttaagatttgttccctgcatgcatcacttcgttacagcactaagactaaggtgttacatttcttcccgtgccagggaagcagcacagaaaagcggtaactgagaatgtgggtcctttccgccagatgtgagagattaggaaaaaaaaatttaatggtttttaaagtgggtcctgaagccagtttcttgcattggaatctggcttcaagtgcctctgtttctacacctgtaagacaaggatcatcacagcacctctgtcatcatagggtggttgggctgagaaagtctgagcagtgcactttgtccttgggaactgctcagttattacctcttattatgatgatgctggtgatgatgactgtgagcatgataataaagattttctggaaagatgatttgaaggtgtgactctcatgtgtgtccatgagagggcagcctaaaatcatgcatgtctgtggaacaagcagcctctgtaaagcctcaaggtaatgtgggcagtttcaagtgtgtttggccctttttcttctctgtttttcttttttccctctgtttgaagagcgctttcagccattttcaggcttactttagatacggagcaggcccatgaacacctagagggcagcatgggcagtacagagctaggttcaggccctgcctgggtgggtgagtttgtgtaggtgccaatgagagcgtctgtctaggcgtcctaggcttttctttgtaacttttcacacagaactaattcttattaatcagactcttgaggtagacactagaacctgactgtgtttagagaaaaaagaaacttgattttctatgcttgttccccttccactaacttcacacctgcctctgagcattgtgtgcatgcattggtgccaccatgtaaggggacagtggccggagctgtatagacccagagttgcatcagccacacatggctctggaacacaccaggggagactgagttacagagagagcagaataagagtcctcaaaccatgtgggagcacagagcatcatagggctgggggacagtgggggtcttgaagatgggcagggtttaaacagatggagcagggtagaataaaggatggcatgagctagaaggtgcatgggagaaagggcagtgctgaggtaaagttgggaaaagagtttggagtcagattgcggggtggctggaatgagctgaggagttggcctttaaatttttgatgacgttcatattgttgatagtgtcataatgattaagagatgaccaaaaacaaaatgaagaatggcacttggatttttctagtacttatctcattttaatatccctgatatttaatctaggctgcaaaaccagatgtatgtggggaatcatgacaatccagtgtttgtcacgccatcccccttcctcattcccactgcctacactgtgggccaggccttcaggcctccctcctggacagcagcaggaacctccttagaagaagcacaggttgctgtggcagcaaggcacactatgatgccaacttgtgatgctcccagagaggaaggcacagatgctggggaagtgaacctggttatattaacatgaaagctgacttctaaagaatggtgtgcttctttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaagaatggtgtgcttaaatattatatacataatatactgggtccagttgtaacagagtgcagtaaattatttgtaatcctaaaatgatcatgaagatccatttaatcttttgtttagaaagccctttagggttctgcaggggttggttggagatgaaaagctccagggatatttctcagacattttcggggaagttgtcatttgttccatcttatttgttgtagatatttggatgattctaagatactaagattgacattggcacaaacttggcagaaccaaaattgaacttgagtgttgtctttcatagtgctcacccaaggagctcatacgttggctcctttcagaaagtaggccgggcatggtggctcacacctgtaatcccagcactttgggaggccaaggtgggcgaatcatctgaggtcaggagtttgagactagcctggccaacatgatgaaaccccatctctactaaaaatacaaaaattagccatgcgtggttgcacgcacctgtaatcccagctactcgagaggctgaggcaggagaatcgcttgaacctgggaggcagaggttgcagtgagccaaggtcgcgccaccgcattccagcccaggcgacagagtgagactctgtctcaaaaaaaaaaaaaaaaaaaagtaaaatgttcagtgtctgtgtaatgagcagtattcaaaattttgtccatttttgtgcttctcctctcccccaggtggtcctgcttcaggcttgggagcctgactagacgaggcctagtgggcttctctgcacactgccaggcccgtctgtcacttactgtactttctgaccccttgtctgcctgggggcaaaggattaaggaaggggctttgtcctctggggctgatgttggcccaactacaggacagcttggcaggtgcatgcgaaagtggtagctgctgcccctcagctgtgtgtgtcatggagagtgacagattggacttcctttggttgaagtgatggagatggatgatgtgcacgtgcagtcagactcgggtgccatgcccagttgcctatagtacttagcagatagggaaagagtgaagaactgaaacataatctagttttctcctttgtaggcatggagggatttttgaaatcagatgagaggcagagattggccaaagaaagacgagaagaaagagaaaaatgtctgggtaagttatgcactttggctattttggtccaagggagtggagatatggtggtgtcttttctgaagattcttagaaatttgtgaatgaatgggaactaggacagttgctagatgaacatgaagaatcaggcgtgaacctacactgcaactggcatgttcacaaataggtaattttcagaatagttcactcggcaaacattgaacctctgctgtgttctagccactgtgttagggtctgcagttacgatattgaagaaagagaaacagtcgctgcccctgatctaaggaagtcctaacaccttcaagtgtcaactgtgtacactccctcaggttctctcttgggaatctaaaagggccatcctcaggagaactgagaaaatcagcacttgagtcattttatattttaggacagagagccctggttgagaaaggccgtcttgcctcttgcaggctgtagacagattagtgcagagtgttcttcacaggatgctgagggagatagcgtttccccattgcattgagacaaatgaggagctttcaggttcttctcttcttcactgcctcctgctggtcggtacaagcattgcctcctccagggaacccttccctgccttggctaggtggaattaagggccccttagtaaatgccttgagggtaaggcaaattttgttcgtgtgttttaccccctgacttagctcagtgtctggtgcttggtgcacacacagttaaactgcttttgaatgaacatagccttataagcatcattgctcaacctagcatatagtttagccattatgcacaagtttgacttaatgacagccgtcatagtcatagctcccacgtggggaggcacttactgtgaacttcacggtcatcatcttgttcaatcttaacaacactgtgatgtggcaaacatgactgtccccacatcgtagaggaggaaaccgaggcagagagatgatctagctaacatgcttagggttacccagctagtggcagaggtaccagaaccctttatctcaatcactgcatgctaggatcctaccaggctctttttagggctctgctcttgcttccttgtttttggtcttaatccaaactgcatgggatgctctggtaatgacacctctcttctactttccttccccagctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggtaaggcccaggtgcaccctccgccaccttccagccccctcagcaggctgctcagagtgcctgggcatcctgcccagctctggggtaggagagagacctgccgtgcaccttctccttggtggctcccatgccttctttcagcaacatgacatgaaactcgaagcagcactgacatagaaccgcagagacttatccattcaactcaggtgttaatttgctgtgtgatcttgggcaaactggttggcttctctgggccttgatttgtgtgtctgtgaagtgagggttggatttggcagtctccaatgcctcttttagtcataaccttttctgactctaagactcaaagggtccctggtggtctagtagataggggaaaaaaaaaaagactcagaggagattgtgggtagcggctgggtgaggtgaatctgaggattacagatgggagttcatgcctccagggcaggcacaaggccagaacaagagcttgtgaggttgagaacaatgtgatcctgtcagttgctactggcaaattagtctaccctcaaataccaagatgctaatatatttaaagtttaatgtagttcttcgctttaattgctctttccagttaccttttaaaaaagaaatggcacataattacccctacagagttctttattactaaattttgaaaatatatttagaaagcatatttggattatagattttcttcacgattatatttttaggaggtaataaaaaccttatgtcagttgatgataattttttattcataaggtataatgattcatcttttagtatgaacaatatagaggtttggtaatctccaaccctataggatatgaagatgtttgtacaaattcagtattttttaaaatctctgaacagttgcttatcactatatatatttaccccttccttcttttttttttaaagaacacatacgaaaacacacacatagtcagacccatctttgcccaagaagcaccctttcatggtgatttctttcctcctcttagaaaatgaggtctaagccagtgtcttagctatggttcaccgttattggctgcagtctgattgctgtgccttcatctgctcccagttcaaatgtcagctccaatgccagctctaccactgagcagctggtggccaggggcaagtcacatgcccctctaactctgtctccttagcccaaaacagaggtagttacaggaattaaaagaggtgacttttgtaaaagtgcccagcaaagcacctagcacagagtaatcgttcaggaatgttacattctgtttagttacttcagctgagcttggctaaagcaaggtcaagagggtgctacccacaaaagcttatgaaacagagtcagtagatgggaaaaagccacagtataataggctgttttggtaacttgggacagatttctcctttcctaacttctgtgttaagagttgctggactcacccattttcttcccatcctccattccttgatgacttagagcttgtcctcttcttccatgatctctccattttgaaagcttgtcactgctgcttccaggaaggggtactgtgaagtcacataagacacttcccatgctctgacatatgcattgtcactgggggctgcttttgaggcaatttctgtttataatttttctctacagaacattagtgctggaggcatgttaaattaagtagaacagctcccccttcttggaggtgagggagttttatgccatatggttggtcctgatgcagctgaatcttttgtggtttcccttctgggtaattttctatttgtgtgcttccttgcacccctaatgtggtggagggaagcaggaggctgcccgaccgacccttgtcagcccaagctgagcttggttccctcttctccctgggcacagcagggcagggctgagggctgggcctcctgtggttgtgtagcaacccaaggaaacagcagcctccttctgccacctgctcctgccctcagggtcccaggggacccaggtgtagcttagggacttgccacacacaggctggcttgttagctacattgggtcggtgctctgctggcacagaggcctttttggcattctcgtgggtgacatttagggagaagggatcagcctgcattacggaagcccctcttcaaaggaaaccctctgcactggcccctatgattcaaggggagctctgggagggctgcagcctgctcagtgcctggctgtggatgttctccattctcttctcagtgtcagattgaagtctttttttttttttttttttttttggtcatgttctgtctctgtcagccagagaaaagcctctgcaggaagatcattcatcctatgcaggccattttacttctctagcctgttggaaagtgtttgttgcccaccaaatcctgcctctctgggtctgatacttaggagctcatgagaggcctgttgaccccaccccagccctgccctggctctgtacccctatggttgccatgatgtcactcttgataacccctcatgtctgtgccagggcagaagtgggtaccaccaatggcctgtctctcagaggtcttaagagttggcagaggtcttaagagtagtcaggcctgtcccagggaggggtcccagggaggggtggggtggttctactgtccacttgacaccctgaccttaaactcattctcttgctggaggccacctactccttaagttcttagaaccttcacgtgccacacagctcccaggaaccaagctaccagaacaagttcctgtcacctgtgttagggctgacaacacagtatgccagcccattctcagggcagtatagcttcctgaccagtggccctggaaaattggatttggaaaagccaacttcatgttccttatgctaaacagaaaagagaaaggcctctttctctttctttctttctttctttctttctttctttctttctttctttctttctttctttctctctctctctctctcttttcttttcttttcttttctttcttttctgcacacatccctgctgaggaccgctgggggtgtgtccctgcagtgtcatccccagaacacatgtaatgggccgggcatggtggcttatgcctgtaatcccagcactttggggagccaaggcaggtggatcacctgaggtcaggagttcaagaccagcctggccaacatggtgaaaacccatctctactaaaaatacaaaaattagacagacttggtggtgctcacctgtaatcccagttacttaggaggctgaggtgagagaatcacttgaacctaggaggtggaggttgcagtgagcagagatcgcaccactgcactccagcctaggtgacaaagcaagactctgtctcaaaaaaaaaaaaaagaacacatataatggcagttgaaaaggcacagccaccccctaccacccattcctgccagagactgctgtctgagtaacagtgtctggaatgtgccctgctggcaacctttaatactgttcagccagttcagcggggtcaccttggtcgtgattctccaagttcatccagacagatctaaagccagacctcaaggcatcaagtgtgaggctcgctccttccttctttccttccttatctccctttccttcctttctatctttccttccttcctctctttccttccttctttttttccttccttctttccttccttccttcctatctatcctttcttccttcctgtctttcttccttcctatctttccttccttccttccttccttccttccttccacccttccttccttccttccttccttccttccttccttccacccttccactaagccctacctaatagaggagattctagggacgaggatttgccttgccctttccccatcctctgttgatcatcagatgatactcaggagaaccagaacttggcaggaattgcagtatgcagttctgatatttattaatactgtttttctaatgtgatggaactttctcatgctcactttctgttgctcagcctttcctctaaccagtggctcttgcttgggggtcccatgaccagcagcacctgggaacttgttagaaatgcagattctcagcaggctccaccccagacctattgactcagaaactctggggataaaccccaggattttaataattcctccaggggattctcctacctgatctctcagatttgagaactattgctctaaatggtcctgataagaatcttcctctttaaattcagattcacttagctttggttaaggacttactgcatactagtcattatcaaatagacttagagtgatctggtgatgtaggtaagctcatccccattttataggcaaggaaactgaagcccaggactgcaatgttagctcaaggtcacagggataaaaagtgtcaggcagaggtgggatttgaatccttacctcctgattccaaatctgagatcctttctgtttcgtcatatgaaggaacaaaaaggtacacacaaacacgaggcaatactgacctattcaggactaaccttaaataagacttgtgcactggacaagttttgttttctatatgtatgaatcaccccattctgactttttggggttccataaatcctcttctcttagaacttgcttatcatctatttctcatcatctctccaaaagtgggtgatacaaagtgagtgtgtctttctctcagggacaactgtgttttcatcggcctcctcaaggtctgaaggaatgaatctccagtggtgggatttggagcagctcagtggactggggatggatggcaggggtagtttttctagaggccattgaaaagtccaggggcaggtctggctttcagtgagcactcattcccttacaagggtgccccccagatagctgatcagtggtcaggctggttcagtgaagctcactattctttcttttcattggtcccctagtagagaagggaccactttgtgaggtccttctggcatgtaggaaatctaccgtaacccacccaatacttaattcactctaggatgaaaggtttcaacacttcagttaggtcattggttaaatactttacgttaaaccgtataatgaaatactattcagccccaatctcgagtggctgtacttcaggcatcacatggcagagaagttctcttccttccaagccccagcttttatcaggcagactgccagagttggccatcatcgtttaatgggccagggtcgtgaggactggactctgccaaggcatgcatactcacgattgtagagtctcaggccaaatacaagagcacagttaatagctaatacaaatctaagagttacaggaggtaaaaatccccctttctgcttacaggtccctggagaggcagtctcttagcaaagtgctattcagagaaaaattatgtagaggaggctgagatgtggagaagccagatcctcatctcatccctctggtatagacagaagggataaatccagatacctattaagtgacctttatatgtttctagtaagtgtgacataaaggagcctttcctgatctttaagtcatggttactcagttgatgatgtcctaaattaattttgcttctgtgtgtatttttttaagccatgacaattgtatctttttgttttagaatgggctatgattagcccagttcctggagcacctcggggttgggttttatgagggcaaaagggtgtcattataactgctagctcaggccttctccagtggagatagggagaggagttggtatttgcagtgtcacggaggtggtggggagtgcagaattagagcaccttcactgcagcagcaaggacaactttatgaaagtaacaatttgggtaatacaggagagtgtttttgataaatactgttacgagagaagccgaagcctaatggttgtttttctcttctggttaaaaattactgggttctgcctccctgcctcctccacctaagtaactctgggaacgcatggatgcttttttttttgtggccagaaggttctttactcttgcctcttgaaaattttgaaatatgcaatattatcccagattactatatagcagaaaagcgtcacactatgtaaaacagttggttcccctttaagaagttctaagatgaaaatgcagctttgcaaaatagatctcagtgtcatgtatcaccccaaaaactcaaattatatttgcattaaaattttctcaaagcaaaatgttttatgcttttaactagaaaggatgctcttggttctggagcagaattccagctctcctggttagggcaaaatgccttgagataggcctcaaggagttaatgcttattgggcattattcctagggcagcttctccccagggaggggaggggacaggacacacggtgtttaggttgagagccagtgctagcctagccgcattgtttactctccacctactcagaacacgctggtgtggcagagagagcacgtatgcctgggttttggatgctgagcacagaaagccccatttggtgactcacactgtgcactgaggcagcaggtagtgtggtggggctgggtagttaatcttgttaacacttgccttacacgaactgtgtaggaacggctggaggcgatgatgcgccggtccctggagcgcacacagcagctggagctgaaaaagaagtattcgtggggagcaccactggccattggacccggaggacatgatggtgagtgtagggttgcccctgtatttcaggtcctgggtgggaaataatggagcaggcaggggattatgggcaccactgggtgtctccaggatctgggggatgctttgcacagcttttcagaggcaccactttcagatgtgatgtttaaaactgccaagattcctacgcatgcatttgttatgaaggggatctgtgcattcttcttgatagcaaacagcagttgacacaaaaactgggttttgagggagagcaaaagagaagactttgaacgcagagcccagtgagctgggcccagctggcaagcccagggttgttctgacttcaggggagggaaacggcaggaggctctgtcactggtccagatgcgatcaggaaaagcacagtggcagttatcctccaaaaagggctggactatttcctgctgcattttaaatttttgttgctttttcgactttgtttcaaggtgacttatttcattaccagttcaaactcatctttaaattttcaaatgtgtaatttaatatatggattgttactagtctctggatggcttttccttcttttcagtgtctcactacatttcagcgatcttagcattctattatgcaggaggtgtgtactagctctatctgagagcaaatggatttgtgtttacaggacagttcttgactttgctgtattgtgcttttcacctttgggcagtaaatatactttattttttcttttttgaaaagtcaacaacccatttcagttactttttctaatttcctaattagaaactaagaagcaacaagaaattgggacttttttcttttacctctctttgctctgattttttgctgtgtaggtgaatcagaaaataccccaccccctcctctaggtttagcagccagcaccctccctccggatgcagggaccactgccgcagctgccgagtccaccaacggtatatccgagcatcactgtgccatagcattttgtgataactgttctgatcatcctcccccatcaccatgtctgcgtcaagcacttttacaattggtttcttagtctggcctgtcacaatttttttttcctagcaatgtgaatgacatgcccatatttctttgttcctctgtcattatagagcggtgcatgccttacatcttagtgccccggagacatttcatcctcaactcactaacgtctgccttgaaaatcttgtcagtgttggatttttgcacactcagatctttaacaatctcttcatcatctgttgtagacattaagaagcagggcatttctgattacttctggttaccaaaacctgtaatcacccggagttctgaatggagaacttgggcttagtgttaaagtgatagattcctggagaggtgtttgagagggagtggtaggaattttatcagtgctaacactggtaatccaaataattagataatttggctttgtgcttgattttatttaataggctgtctgttttgtatacaggcctgggaaactcctctggtctagatcaagaacagaactagccaaactttgtttccatttaataatgactttagaaattcaatccatcttcaactggcaaagaaaaaaaaaaaaagctgtaaaagggatgcaatatttaccaacaatgcggaaggtcatattagcagtaggaatcaatatccttggtttctgacattcctttgacaatgaataatccttactgggggtgcttcgtaacagcagttttgctgcacaagcagagttacctctagtgtgggcactggctttccccctaagaaaggtgcaggggggctgggcgtggtggcttgtgcctgtaatcccagcactttgggaggctgaggcaggcggattgcttgatgtcagtagttcgagaccagcctggccaacatggtaaaaccccgcctctactaaaaatacaaaaattagtcaagtgtggtggcgggtgcctggagccccagctactcaggaggctgaggcaagagaattgcttgaacccgggaggcagaggttgcagtgagatcgtaccagtgccctccagcctgggcaacggagcaagactctgtcttgaaaaaaaaagaaaaaagaaaggtgcagagaggtggagtaatcacccactgggaatcagcacccagggcccgggccagggtgaaatgagtgcagtacttgactagagcatacaatttaagggagtgccaaaaatctcagtaataaagataaaataatatcttaatgtgatattttttaaaatccaaattaatgcaaaacaatccataataaacaacaaatttctaaagactggtgccatgctgagcacatcagagcctgaagcaaaagggaaaatgtgtactcctatatacgtggttttatgtaatttctaatgtttagttttatcaaaacattaaagtagtttaaaatatggaaaaattgaaaagagtattaaaactcatataatttcaactttaaatagttttatttctacacaaatcaaatttattgtacttttacttcagctttagttaattaaaaattaccgggccaggtgcagtggctcacgcctgtaatcccagcactttgggaggctgaggcagatcacgaggtcaagagatcgagaccatcctggccaacatggtgaaacactgtctctactaaaaatacaaaaattagctgggcgtggtggcatgcacctgtagtcccagctactcaggaggttgaggcaggagaatcacttgaacccgggaggcggaggttgcagtgagccgagatcgtgccactgcactctagcctgggagacagagcaagactctgtctcaaaaaaaaaattatttaagattgtcatttggtcagcagaaattatagaacatcgcagttcttatggcagttctcatgggaaaacacgatgagcagaggagtagattttgaaaatattattgatgagtttgcttttttacaaccaagagcacacatttttcttttggcctcaggctctaacttagcttggcagggcactgtcagcatctctttgtttgccgtctgaaataatgactggaacgtaagaacaccaaactcagggtcgcctgttaaaatgctaacctcaaacagttaaagcatttgcaaaaggaccattttgatctgtctcttactaagtaagaaaaggaaaaccaactgctaaagaggccgttctgctttaaatacaactctgagaggacggatttcatctctctccaacctgagctacagataaccttcataaaagagtcggtttcagcaagcggtgacagtcagaccatagggcgttttccagtggtgatttgtctctgggtccaagttggttttgtttttgtgtgatgtgagcatgctcaaaaatccctagacaaaagaaaatgatttgttggtgggattaacacggcttcagttgaacagttgagtgaggttgaacatttgaaattgaagatgacaacacagtgaagaagttgcagagattttgctgcagaccaagggctgctgtagcctggtcatttctagagtaggataatgagatgccaggatgatgaaagcagagcatgctgtgccacagcatttaggaggtgcgtggatgaggacaggaaggacacttcgggatatgtgtttcttggttctacagtagtgtgatgaataccaatgtctttaatgcatttctctgcagcatgtgacaaactttcaacatcaactatgagtttgccaaagccaacggagcctcccatgaataaacgcctgtcttcatccaccgtggcaatatcctattccccagaccgaggcaagtgaacatgtagacttggtctctctagtttgtttcttttctggtgtgagcatcttaacgtttgtctttgtgagagtctcctcttgagccttctgcagataccgtcattgtcctagtcttgtggtctgaatgtgggagctctagggccttgtcagtgggactttggaacgtggcacggctctttagagccaggtcgttgttgaatagaggtaggaattaatgcagtctcccagtctgaaagagactgttctgttttccacattgcatgtaggagttatcctgcccaggaattaattaaccagtgggcagatgtgaccattaaagtaactgcctggtcaatgatggaatacagttgattagccagaaagagcagaattgataagttatagttatatgggaggcttagatatgtgaaaaaatggggttctgcagtcatctgtggtttataggcctgcccattttgtagatgaaaagagaagcacagaactaatgaggcctctaaaagaggaaaaggttgggtggcgctctgttttgagttaggagatgatgtgtatgggacgtgtgccagttccagaacctgagtagatttaacagggtctgcattctcacaaaggctcagataagtcactgaaagtctgtttatacctttcagagtatacaggttaaggaaatgacggaagctctccatgcactaaatgtttattctaaagcaacattgaagaagtatcaggtgccagtggagtgtttagcacaagttatcaccaagggcagagcaaaaggctggttgcgacttggcagaggctggtgtgccttcctggttgtttccactgacattgaccttgtacctctatcccagaggcatattatgtgtgtcagagaccctataaggttcataatgctactgatctgtgatgcagttcatggtaagcaccaggaacctggaagtgatgaagagctgaatacagagtgagggaaaagttaattcattgccatatataatacattcaaaactgatctaaatattttggtcattgacttccagattatgaatactactatttgtctttcattaaagctgataatcagttggctgtttgtatttttgtgcctctcacttaatttttacccttattgacatgtaaaaagtatgaaaagatatatttttatactattacaagatgacattttatttaaaaatcagtgtgttatgaaatgcttcttagcgcaggacctaaaacaagtgttttataggcataatttgttttctacttggagtaaaggtttttttgttgttgttttttttgttttttttttgtttgttttttttttgagacaggctctctgttgcacaggctagagtgcagtgatacagtcttggctcactgcaaactctgcctcccgggctcaagccatcctctcacttcagcctcaagtagctgggactacaggcgcatgtcaccatgcccagctaatttttttgtattttttgtagagacgaggtttcgccacgttgcccagggtggtctcaaattcttgagttcaagtgacccgactgccttggcctcccaaagtgctgggataacaagcatgagccaccatgcctggccataaatgatttcctgagtccatattacatctgggaggtgggctaattctctgagtgatacaggttactgtactgcaatagcatattgaatggattttggtacctagtgacaattaatgcactctcccaaactctaaaggacacattatttgttttattttacgatgacaaattccaaatccatcctttgttcaaatatttttattttccatgttctgccacccaaaagttaatttgcaccatgcattgtgttgtttaaatgttttattttgttttgttttaattttgctttttaaaattttcatttgattccatccctcagctcatcacatgcaccttagtccaatggaagccattcttgtttcgcgactgttgacacccacacagtcttctttagccagaagcagagcttcagtcatgctctctgggcaggccaatgattcaggtaaaagaggctaagctggtaacaccaaggaaaatgcccgaagaggtgttggtcagcctaggatttactcctgaatttttggattttgcttcctatttgctggctttgtgaaaagtcttcattggttaataacgtcttataccagtgttttgctgttttatgtttcttttgagtgtcacagaggtgagtaaattatcttatgagtgagagcatgttctttaggggaagaaaaccccacttgatgaactctggaggttagtagacttttcttaagagacggtgtggcaaaacagcctgtagaccagtctggggtgtcccatagccagctctaccactcactagctctcaccattgggggtaagttaattaacttctttaagcctcagttttctcatctataagatggagctattttaaattattttgaagattaaatgagagagtgcatgcaaatgagatagcacaatgattagcacagaatgaaagctagaaactttgagaagtttctagcctcactactcaaaaggtggtccatggaccagcaatggcagcagcatctaggagcttggttggaaggccccacctagcctgcacactgaagtctgagaaacactggaccagaccatcaaagccctgcctttatcaaagcagatcaagtcgtcatgtcaggatttgtggcggctggcattctctttgtttccagatgagcagcactgtgtccacctaaggtcaggtctactctctgttctccagatagtgtactcagttgtgatgatacataaatgagataaaacttctgcctagttgtagctgcttccaaacagttatactgtttctgcaaataagttgtacagatagctaataggttcataagatgctcaacatcattaatcattagggaaatgcaaatcaaaaccatagtgggatgccactttacacccactaggatgactagaatttttttaaaaggggaaataaccacgtgttggtggaggtgtggagacactcttccctcacacactgctggtgggaatgtaaaatgatgcagctactgtagaacacagtctgaccgttgctcaaaaacttaagcatagagttcccatacgacccagcaattccactcctaggtatacagccaaggaaattaaaaacatatgtttgcacaaaaacttattcacaatagccacaaagtggaaagaaaatatgatatacccataaagtagaatattattcagctataaaaagaaatacaggccaggcatggtggctcacacctgtaatctcagcactatgggaggccaaggtgggcagttcacttgaggtagggagttcgagaccagcatggccaacatagtgaaaccccatctctactaaaaatacaaaaattagctgggtgtggtggtgcacacctgtaatcccagctactcgggaggctaagacaggagaatcacttgagcccaggaggtggagactgtagtgagccgagattgcaccactgtactccagcttgggtgacacagcgagactccatctcaaaaaaaaaaaaaaaaaaatacagatacatgccacaagatggatgaaccttgaaaatgtgctaagtgaaagaaaccagttgcaaaaggccacatattgtgtgcttctatttatgtgaaatgtctgaaataggaaaatccatggagatggacaatagatggtggttatcagagactggaggagggaaggaaggggagtgactgcttaacggacgaagtttctttggggaatcttgaaaatgtttttagaagtagactgtggttatggttccacaaccttgcaaatgtagcaaaacctccaaattgtatgtgtatatgtatacgtatacatatacgtatacatatatgtatatatatgtatatgtatttaaagacagggtcttgctcttttaccctggctagaatgcagtgatgtgatcatagctcactgcagcctcgaactccaagccctcctctcacctcagcttcccaagtagctgggactacaggcacacaccaccatgcctggctaattttttgggttctttggagggacaaggtctcactatgttgctcaggctggtctcaaactcttgggctcaagcgcgacccatctactttggcctcccaaagttctaggattacaggtatgagccaccatgcctgtcctgtatactttttaaagggtgaattttatggtatatgaattatgtatcaaaaaaccctagcaagtaggaagtaccccattttgagaataaggaatatgttggggttccctaagagcaactccaggatcagtgatttgctaggaagactcacaggatccccagtgaaaggatgcaagcaaagtcagcaaaggagaaagacacatgggacaaagtcctgggaagaccaggcacaagcttgcagagtcctctctggtggagtcactcaggacgcctttcaccccagcaatgagttacgacaacatgtatgaaatgttgccaaccagggaagctttttagagactcagtgccaacggtttttacagagggctggtcacatgtactccatgcccagcacatacccaaattccaggttcccagaaggaaagcaggtattcaacatacaccatgttgtttgtttatgccctgtgagccactcaacagttaaagggggatcgtcctaaaatgtacgttcccaggtgctggctaaaggctaaccttgtaagcaggccttagtagggacagcagtcaggcttgctatgttaactcatttttgcacagctcacccacttgacccttggccaaggtgtctttacagaaaatttttcagtagggccccacatagcagggggtgagaccatcctgcagtattgatctcagttatgtcctttaggggttctgggacttagcagttaaagcaaatctcattaaccagaaggtctgtcttttttttctctctttcttttctttttctttttcttatttatttatttatttatttattttggagacaaggtcttgctctgttgctcttagccacgctggagtgcagtggcatgatcatggctcactgtggcctcaacctcctaggcttaagtgatcatcccacctaagtctcctgagtagctaggactataggtgtgtgctaccacacttagctaattttttttttttttttttgtagagatagggtcttcctatgttgcccaagttggtctcaaactctgggactcaagcgatcctcccacctcggcctcccaaagtgctgggattacaggcttaagccactgcacctggccttagaaaggtctgtttgaggcagccaggtggcctcctccatcagttgctgtatgaatctttttacctggcctgtggcatcagctcaggcccagaacagctctggccagtaagttgaaactgatctgaatgccttccaggcctgacgccgtgtcatgataatcgtggcacgcacataggaactatgatccccaagggctcatgtggttccctggaaaaaaagagttgaagatgttagggcacactagcagggtatcattggtcagtcagttcccagtgtggcctcccactgtggtgactggtgcctcagggtgctcagtccagtgcaggtaattcagctcagtcccaggttttatggcggctgcctgaggccatcagtcccaaacagttctaccagtgaccctacttcatcttcctggcaagtgcagatggcatctggagctgttctgtggggacatgtaggaactggccccactcctgccggctcatagtcatgctgtcacatgccatctaggctcagccatgggtctgagtccaaggtgctttcagcacaaggagttttccttcaggaaggagagcgcttccaggagcagttatggaaaacagaacacaaatgtccttccgtatccctgtatcatttttaccccaggtgttggattatgttgtttttctccatgtcctattcaataatcaaaactttacattttcttaatcatcccctactctcacccagacctttcaaagaaaggacaaaagcatttcttaaaacccatttttatccaacttaaccagaaagatatattgtgttcaggtattaggctaaaatcctaagttttcgaaacattttaaagtaggtttgtatcacctctgagccctttcatcttgatcattttatccagtgagcagcctagaaaagatcaatccctttccagtgacagctgcatttaacaaattgctttactgacgtgtgtagtgagagaaaggtagaggaaatatagtcaggatctcagtctattacaaactgcagctactccagaaaattaaacacaaagcatcaacagcagtgacactttccccagagggaatggagttcagtctgtcagggatggctgaaagagtcacattgcctgtggtgtgacttggagcttttgtaggaatcatgtgttgggaatataatcagactctgcatcagaaataatagagccaatgagcagcttgattgtggatggtcccatcagagaacaagccctgtcttgtgggcacttgtatgtgacccagtctagcagcatccagaatctttttacagttttgggccccatgaagggcattctatatttgtagtggtccctactcgatttttaaaactccagaagcatgtcttttcctagaaattgcctgtcttttcatatctccccttttcaagaggctccattagacaaaagtcatagcagaaaaatctactacagagacttgttctggttctaatatttggagtttaaattccagcctacccactgctggcaaaaagcaaggaggttgtgtctaactctcacttggaggagaaaacaaaaaccaaaggcatcacttgggctgtgctttttccctcactttagctagcatgctacagtcaaaagcagccagggggatccatcaagccaactctcttggagctgtattggtcatctttaaattccgtaggtcacttttacctctcaaaacagctcagctgctgttttataccatggataacttcatagccacccaggcatcacaagtttgttctccacccttttgtccttttcccaaaatgtgattttaccacgtttcagcaaatcagggtcattccagcaattcccatttctgacactagttgtgccagagttccccaagaccaccccaggtttgatgattggctaggagaacttggaagaatcagcatagttccacgcatggctgtgacttattttttctttcttagctttttttttttttttttttttttttcgagatggggtctttctctgtcacccaggttggagtgtagtggcgcgatcttgactcactgcagcctcaactttccaggctcaagcgatcctcctgcctcagcctccagagtagttgggactacaggagtgtgcccccatgccaagctaatttttgtattttttgaagggctgtggtttcaccatgttgccaaggctggtctcaacctcctaagctcaggtgagccaccatgcccggcccatggctatgatttattatagcaggaggaaacatgaaaaaactagcaaatggaggaggtgcatgggactaagttcagaagtaaccaggtgtggatttccaagagtcttcttccagtggagtcacatgggacgagcttaattcctctaccaacacattgtgacaacatgtatgaaatgttgccaggctgggaagttggctagaaactcagtgcccagggtttttactgggggctagatatgtaggcatcccctcccaggcacatacccagattccacactcccacaagaaaagcagatgcttagcataaaccatactgtttgtataaacagtttagacacccatcagttaatggtgggaaccctcctgaaatctaagttctcagatgccagccaagggccacccttataagcaggcctttccaagcacagcagtcagatctgctatgttaacccttttgtgcacaaggaaatcgatgtttagagaggttaagtaacctgcccaaggtgatccagctattaggtggcagtgctaggtctctgtggctccaaagtacagacttttaacccctgaaataaacttgaataaacttgactcttgagtatgggagcctttttagggtaagatccatcctgtgtacaatagaaaagtatgatattgattgcccaggtcatattttaacagaaatgtgttcttcccaactctctgctctactttttccatctgtactctctgtccttctggctgttatactgtaactttctagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtaggtttaaaaccacccacccactcactcctctagactgtgttctgtctgatggtgtgattacttctgtgcttgacctgggctgtctgtttccatcaatctcctgggactgctcaaagcaggaaagggtagatttagttcaaaattttacccaacctttgaaaatcatttaactttttgcaccctcttaagtcttagtaccttggagcaaattcttaatgatgtccttgtcacagcctgccctccagaggacaggagtcagaaggaatgttctaaatatcctctgtcttcctcgttacggatatctgattctgggtcagtcttgcccgtgcatctaagtggaactgaggatctacgtcaacttttacctacaaaagtaatcattaaatattcttttgagatgaagtctttttatgttgcccaggctgaccttgaattcctaggctcaagtaatcctcctgcctcagcctcctgagtagctgggactacaggcacatgttactatgccaagcttaaacatttttgatggcatactggcactatcagtaaattaaatgttgagaaggcacccccaattgtgtctatttatttagaaattacacagtgccatactacttttgttagttattgattgctacttaacaaatcacctcaaaccttggcagcttaaaataacaaatatctattaattcatgggttctttgggtcagaaattcagagtgacttagtggttctggtacaaggtctttcatgaggtgtggtcaagatgttggccagggctgcatcatctgaaagcatggctgggcctcatctgagacggctcattcatggctgttggcaggaggcctcggttcctcactgcatgggcctgtccataaagctgcttgagtatccaaatgatgccacagctggcttccctccaagcaagctatcgggaagctgcagtgtcctttaagtaagtcactaagatcaacccacactcaagaggagaggaattaagcctcacctgtcgaagggaggaatatcaaataatgtcaggacttatttcaaaactacttcattttataatgccatattttcttttcaaatctgttgtggctcttagaagtgcatgttttagactctcggattttactatacagtggattagtgttgaaagggattgatggatgtgagtgtgggggccaattgaggacttgctgcagaaaagtgtgatagggagagaagggagctaacccttgtggagcactttctgcaggctgggcactgatgtctgttcccttctgccaaaggaggtaatgggaagacctacaggactagatggggttgcagacccattataccatgtataccatcaggggccacagctcactgtcttggatgttgtaaccacattttcacccacctgtaatttttttgtagtgattttacatttttatactcttttcagttcctatatgtctaagaccgtaatatggttcagttgttaactctttgaaagacaacaaggagaaggaaatctttgcattttgaggctgattttttttaactggataatgcaaatgtgatgacctcatcctgcctccccgcaaagatgcctgtcatgtgaagcgttatagcttcatatcgatccctctgaaagaaagctgtgcattgttccatctggggtattagtcttataaattgtggaagtagtgccagtcatggactgtggctatcctgtgtcccctacaggtggagaaggtgaagcgggggcaacgaacagcaacttctcttcctgttgtgaacttcgggtcccctctgagaagatgtgagttttctggaggcattcctaagagaccatcttctcctgtgatatccaagtaagcatctctcccctttgccagacagtctgactgtcatgagtcagtttgctagggctttgtgccatccagtgttgcagctcctgctcccccgtgaggcgtggccagccagaagtggtaagtgggagaaatgctggccttggagttacgtggcttgactctctgtgtatcttctgggtgaaagatcctttgctaagggaccccagtgcgtaacagggcttttatttaccaagatgatgcattcagcattttctctttaggtccatgaattccattctgcttttctggtattctttttccagttgcatttggatttaagtgattgcattgggcttgggctcctcctgacattctcccccaccttgttgtctctctctttaatagagagacaataataacttgtcagccatgatcaacagtattttaatgaagcaaatatatatgtgtgtgtgtttttaagaaatggggtcttgttgggttgcccaggcctggagtacagtgactgttcacaggcataatcacagcacgctatagcctccaactcctgggctcaagtgatccccccgcctcagactcccaagtagctgggaccactatgcccatgcaccataacaccaccatgcctaatttttgttaggaactaggtaaactcaccaaggaaaccatgtaactgaaaaatttacaataactttgtgaccaccaaggtcttaagtcattaaaatattttactgacagtaactgacaaaagactcagtaaataactcagtccagtaggacagtggaaaccatctttagtaggacagagaaagaaagagaaatatgatttaatttgggaatataggaaagtttttatatggagagaatcatataaaccttattcagtgtatcagtttagttcagagaatgttggataaacacaagtttaatgaaaacttgcgaatttgtcaaaaatatttaaagatgacatcagctcttaaatttccaatgtgttgctttctaatagagactttttcactactattaataattttttttagagatcactatggttttgatacactactaatacctgccattgatgtgtttgtcctccataaggaaaatctttccatagcacatcactgaattaaaagcctacttttctttctttctttatttttagttcattgcaacctttctgtgctagtattgcccatctttggttatggtgttgttatcctaccacctctttaaatttattatgtggactctacgatccgtttccctctgtcttatatctgagcctttttcagcttccacccatgcatcattactctggtgttaattttggacatttgcattaacagaaagaaaagcctagtttacgctgagacttttacaggctccaccctctctctgtcttgctggaatttggactcatggtccctgcagggatactagcttgcaagtttcatcattattattgtaaatggtagtatcttctatagaaatgagaattataggtatacctagttttgttgtactttgcacttcgcaaatactggttttttttgttgttgttgttgtttgttttacaaattgaaggtttgtggcaaccctgcattgagcatgtctgtcgatgccatttttccaatagtgtgtgctcacttcttgtctctgtgtcacattttggcaattctcaaaatatccaaacttcattattattattatatccattatggtgatctgtgatcaatgatctttgatgttactgttataattgttttggggtgccatgaattgcacccatataagatgacaaacttaatgtgtgtgttctgacagctccactgacaggccattcccccatctccctctccttggatctgtctacaccctgagacagagtaatattgaaatgaggccaattgataacccaacaatggcctcttagtgtccaagtaaaaggaagtgccacagatctctccctttaaatcaaaagctagaaatgattgagctcagtgaggaaggcacatcaaatctgacatgggctgaaggctaggcctctggcaccagttagccaagtcatgaatgcaaaggaaaagttattgaaggaaattaaaagtgctactccagtgaacacacaaaccataagaaagggaaacagcctgtgttagtcagggttctccagagggacagaactaataggatagatgtatatataaaggggagtttattaaggagtattaactcacacgatcacaaggtaaagtcccacaatagaccatctgcaagctgaggagcaaggaagccagtccgagtcccaaaacctcaaaagtagggaagccgacagtgcagcctttagtctgtggtcgaaggtccaagagtccaaaagctgaagaacttagagtccagtgtttgagggcaggaagcacccagcatgggagaagtaggccagaagactaagccagtctagtcgtccttccacactcttccacctgctttttttttttttttttttttttgagatggagtcttgctctgtcaccaggctggagtgcagtggcgcaatctcggctcactgcaacctctgcctcccaggttcaagcgattcccctgcctcagcctcccgagtagctgggattacaggcatgcactaccatgcccagctaattttttatattttagtagagacggggtttcaccacattggccaggatggtctccatctcctgaccttgtgatccgcccaccttggcctcccaaagtgctgggattacaggtgtgagccaccttcacctgcttttatcctagccatgctggcagctgattagatggtacccacccagattgagggtgggtctgcctcttccagtccactgactcaaatgttaatcttcttggcaacaccctcacagacacacccaggaacaatactttgcatccttcaatccaatccagttgaaactcaatattaaccatcacaagtccacctcttgtcgacttgaacccatacacatctcctgagatcatacataatcttcaaataaagacaaataataaggtcgtaattacgcctatccttcctacaactggaagcataccaatccccaacccaaatgctattacataaagttaacacttaaatgctgatatgacatcaataaatcttatgtcacatgataaaggaaagagaaaggaaatgacaatagtttcttcatccaccatgaaggtggataaggcattccatgggtccacagatggtagtcttggcagaagcattgcatgcaggatagacaaacctatatccagagtaagggtatacatgcacaaacatgttcttaacaaaataaggaagaaatactcatgcaattacagtcctcgtttctgcaactggtcctgtgatcgtagctggtactgatgactcccttcttctactacccattctgtattctctttgccttcagcaaacacctcagcaggtcgttgtcttttacctggtggagtgacccaaagtttcactcctgaagggtctgggccatttgtagtcctgccaggattgggctcttgtagttttccattgaccttaatcacagggcatggtaaaactaagagatgccctaagggatctcctgtattccacgcatactctttcttacctccattgtggagtagtaaactgatttcatcttgatagtctgggtcaatcaccccagtcaacactaactgtcttcttagcctgttgagttagaggtaggaggagcttaaagtgtccagggggcaatctttgttgtatctcctggtggcagcattcctccctctggaactaagacctctaggccagcagaacgtaatgttgcgggaacaggaagcaaaaattttgctaatgggtcactaggggtgatggtgagtggtgccacttccatttccaccccttgattcctggacccgtgaatcctggctgtgggagaaacagtaccatgtataggacgttgattcagaacatacacagccttgtgaagaactttgccccagccttgcaaagtattgttacctaattggcattgtaattgtgacttcaaaaggccattccactgttctatcaatccagctgcttcaagataatggggaatatgttaagaccagtgaattccatgagcatgagcccactgctgcacttctttagccgtaaagtgagtgccttgttcagaggcaatgctatgtggaataccatgaaggtggataaggcattccatgggtctacagacagtagtcttggcagaagcattgcgtgcaggatagacaaacctatatccagagtaagtatctattccagcgagtacaaactgctgcccttttcatgatggaagaggtccagtataatcaacctgccaccaagtagttggctgatcaccttgaggaatggtgcatatcgagggctcagagttggtctctgctgctggcagattgggcactcagcagtggccgtagctaggtcagccttggtgagtggaaatctgtgttgctgagcccatgtgtaacctctatccctgccaccgtggccactttgttcatggacccattgtgcaatgacagaggtggctggggaaagaggctgagtggtgtccacagaacgagtcatcctatccacttgattattaaaatcctcctctactgaggtcacccgttggtgagcattcacatgggatacaaatgtcctcagtttttgaccactcagagaggtccatccacatatctcttccccaaatttctttgtcaccaattttccaatcatgcttcttccaagtccctaaccgtccagccaaaccattggctacagcccatgaatcagtatataatcacatatctgaccatttctccttccaagtaaagcgcataaccaggtgcagtgctcggagttgtgcccactgggaagatttcccttcaccactgtccttcaggaatgtcccagaaaggggctgtagtgccgtagctgtccactttcaggtggtgcctgcatatcatccacagccatctgtaaatcaggccctagtcttctcttcctctgtcaactgatcatagggaaccgcccaccaccacccatgaggccatcggtgcgggctgggggagagaaggcagggtgacagggcatttgagccacttcctcatgtaatttgcttgtgccctcaggacctgctcgagcccgatcatgtatataccatttccacttgatgatagaatgctgctgtgcacaccccactttatggctagataggtcagaaagcacccagttcatgataggcagttcagatcacaaggaatggcttccttgctcctcagcttgcagatggcctattgtgggacttcaccttgtggttgtgagtcagtactccttaataaactcccctttatatatacatctatcctattacttctgtccctctagaagtattttggtaccaggagtagttctagaggaacagaatattaaggatggagttctttcgttggttttggggtttctggagttggcttctcagaagcaaggtcacaactggctcactggctctgtgctgcttctttgaagttgaaaatccttttttttttttttttttttttgagatggagtctcacactgtcacccaggctggagtgcagtggtgcgatctcagctcactgcaacctctgcctccagggttcaagtgattctcctgcctcagcctcccaagtagctgggattacaggggtgcgccaccacgcccggctaatttttgtatgtttcgtagagatggggtttcaccatgttggccaggctggtctcgaattcctgacctcgtgatccgcccaccttggcctcccaaagtgctgggattacaggcatgagccaccgcgcctggccgaaaatctttttttaaaaaacttttattttagtttcaggggcacatgtgcaggtttgttctatagatgaattgtgtgtcacaggccaggcgcggtggctcacacctatagtcccagcactttgagaggccaaggtgggtggatcacaaggtcaggtgtttgagaccagcctggccaacatagtgaaaccccgtctctacaaaaaatacaaaaaattagccaggcgtggtggcacgcacctgtaatcccagctactcgggaggctgaggcaggagaatcgcttgaacccgggaggcggaggttgcagtgagctgagatcgcgccacttccagcccaggcaacagtgcaagactccgtctcaaaaaataaaaaataaaataaattgcctgtcacaggggtttggtgtacatattattttgccacccaggtaataagcatagtacccagtgggtagttttttgattctcaccctcctcccacgctccaccctcaagtaggccccaatatctgttgttcccttcttcacgtgcaagtgtactcattgtttagctcccattaataagtgagaatatacagtgtctggttttctgtttctgcattagttcacttagaataatgtgaagtcgaaaatgttgaagaagattgtgtttctagaactattttatacacacacacacacacacacacacacacacacatatatattttttttgagacggagtcttgctctgtcgcccaggctggagtgcaacggtgcaatctcggcccactgcaacctctgcctcccaggttcaagcgattctcctgcctcagcctcccaaatagctgggactactggtgcgcgccaccacacccacctaattttttgtggggtttttttgtttttgtttttgtttttagtagagatggggtttcaccatgttagccaggatggtctcaatctcctgaccttgtgatatgcctgcctcagcctcccaaagtgctgagattacaggtgtgagcaaccacgcctggccaactattttatattttaaaggacacatcatctgagttttgtaaaagctgtccctgatcaaagggacttggttaaaattccagacttttttatgcagtttaatttagagaaaaaaaatttaatttccactctgtctagaacactagtaggcacatagtaggtgctataaatatttgtggaatgaatgaatgcaggtcactatgcccagtgcctcagagaatccccaaatgagtgagaacagtccctatttcaaggaacctccagcaaggtgcggggagccttgtacacagttgagcacagtacaggccctaatccaaagagccgcccatctgctcaggactctgctcagccatcatcctctccatagccagccaaagctgaattcacccccttctctgtgttgacagagcatcatgtgcagccctctttcattcactcacttaacatccagccctcttctaagggctgaggatgcaaaagtccctaccctcctggagcttatgtgacagtgaacagcatggataagatcaggtggcgataagcactatggaaaaaaaattaaaccggttcagatgacagaggggtggaagggagtagctggataaggtggtcaggaaaggattctctgagaaggtgacattatagcagagccatgcaggaaactagggcataggcggggttggtctatgcctcattgcttggtgttagtattttatacttagcaatctcctgctagactgctatgaggttgggaactgtcttgatttattgttgcacagtaggtgctcagtatgtgtgtgtgttagtctgtttggctgctaaactgactggcttataaacaacagagatgtatttctcacagttccggaggctgggaagtccatgatcaaggtatggccagagtcagtgtcaattgagggcccatttcttgattcatgaacaaccatcttctcagtgtgtcctcacatgatggaaggggcgcaagggagctctctggggtctcttttataagggcactgatgccattcaggaggattccaccttcatgacctaatcacctcccaaaggccccacctcctaataccaccaccatggggttagggtttcaactcacatgttttgaggagacagaaacattcagacatagcagtggtatgggatgcaactaagaagggaaggagaagctggggggcaagggcagggtcacctggcagatagggaaaatgttgagaccaaacctgctcaaggactttgccctttgttcactcctgagctcaaatgacccacctgcccctgcctcccaaagtgctcaggttacaggtgcgagccactgcacctggccagttatatcattctgtttttttttttttttttttttttttttggagacagggtctcactctgtcgcccagtctggagtgcagtggctcagtctctgctcacagcaacctttgcctggcaggttcaagcaattttcctgcctcagcctcccaaatagctgggattacaggcatgcaccaccacgtctggctaatttttgtatatttagtagagacagggtttcactatattggccaggccggttttgaactcctgacctcaagtgatccacccgccttggcctcccaaagtgctgtgattacaggtgtgagccaccgcgcccggccatttatatcattctttataccttacaagttttgtaaatattctcttgcatactcattgttggaaaaacataataaaaaagacttacttgatttttagaatgatgccacacacaaaacaaacccccaccaaaactggtatttttgacattccttctgtgcagaccaagtgtgtgatttttaaaacgcactggaaatgatgtggctttgaaaaggggcttaattagccctatgaactcacccatccagaatcccaggcaggtcatgtgattaatgataccttttcctgtgacctcctaagctctgacagtgcattgttctcctgcctgatgtcagataaactaagccactgttgggtggctgtgcatgttaatagcattgctcttttaagcgttcaagtttatttttattgttttcatcattgggtacttgcatgggttttagaaaactagattcaacaacactctgaaagacatagatggagcatagctttgttcccataacctagagaaaagaaatccagtgtggccaagtggatttgtccagcccatctctacctcttgagtgttgatgctgcctgtacttccaggtcttcagtgtgaaatattctctaatggttttatattcttagaaatatattctaagtcagtttggtcattacgataggtaatatttcagctatctattactgctgttacaaagcccccaaaattgagttgcttaaacagtaatttattattcattttcacagttctgtgacttgggcttactgggaggttctctctttggatcttttgtgcagttgctctgtgggttgacttgggttactcagggtcttccatgccattgcagtccagtgttgactggagctgcagttacctagagctcagatgagctgaaggttcaagatgggccattttcctacctggcagttgatgatggctattggctgggagctcagctgagtctgtcaaaccagagtgcctactatggcttctctgtatggcttaggcttctcacagtgactgggttccaacaagaaatggccccaagattgagcatcttttgggtcaggaagcggaagctgtcaggccagtgaaggactatgctctcaattggcacagccttacttgtctgctgtattttataggtcaaagcagtcgggccaacctagattcaatgggatggagagataaactcaaaagataagatcttgtgggatgggagatattattgtggccaactttggaaaattcagtgtgccaaagataatcacttccagaggtagatcatagctgagatcagttttgtttcagggacctagtttaatttcactttatcatgtgttgaaaacaaaacatattccatatgagggaaaaaattaggataaaggtgtctggatggcccaaaacaagtacctcccactttactccaaatcacaggcccgtggaaggctccctcccagacccaggctatccctttggtggctgaggacatttaatggatcctggccaagtgcccttcccataagcttctctgggagatgtgtggcttggttatcctctcccacagataagcatctacagcacactaggctcccacaagggcgacttaactgctgtttttgccaccacatcattctctagtaggcttttacattcttacctgaaattcttcctgaagagggtaattgaaaatgtcaagtgatgtcccctccttgcagccatatctatatactcactcagtcctgtatttttgagtcttatcagaggatcatttgaatttagaccaattttttcagcttttaaatttcgaaatcatttcaaccttgcaaaagaatcacaagactagaacacagaactctttcttccccaccttttatcctgtattaatgtgtagccacatttctgtcatccttcccatcccctatcaccctcactcagtcttgcacagtctctcacattcatcctccatagatgcacacacagacatacatacccagatttctcccagaaccgtttgagagtaacttgcagacatcatacccctttgcccctaagaacgaagacattattttccattgttatggaaatcagaaagtttaacttggtactgttacttaatttctaatgtatgtgcaacttttgccaggtgtcccagtaagattctgggtttttttgagacagactcttgctctgtggcccatgctggagtgccgtgctgtgatctcggcttactgcaacctccgcctcccaggttcaagtgattctcctgcctcagcctcccgagtagctgggattacaggggcacaccaccatacctggctaatttttgtgtttttattagagatggggtttcaccatgttggccaggctggtctcaaactcctgacctcaagtgatctgcctgcctcgccctctcctttgtactgggagtacaggcatgagccaccaggtctggcccaataagattttttatatcattttttttttcatggtccagggtccaacccagggtcccacattgcatttaattgtctcaccttcttagtcttctttcaactgaaacagttcctcagccattctttttcctgaccttgacattattttattttattttattttattttattttattttattttattttatttttcgagatggtgactccctctgtcactgaggctggagtgcagtggtgcaatctcggctcactgcaacctccgcctcccgggttcaagtgattctcctgcctcagcctcccgagtagctgggactacaggcacatgccaccacacccggctaattttttgtatttttagtagagacggggtttcaccatgttagccaggatggtctcgatctcctgacctcgtgatccacccgcctcagcctcccaaagtgctgggattacaggcgtgagccactgcacccggctgaccttgacatttttaaagaatataggctagtcgtcttgaggactgccttcagtttggataggcctgacgtttcctctgattgcattcaggttgtgttctttgggcaggaatctcgtggcagaggtgttgggtccttctcagtacctcttatcaggaggctatgatgtcagtttgtttaattactggtgatattaactttgattactggattaaggtggtgttcccaggtttctccggtataaaactgctgctctttcttatctaggaagtaacaaacttttctgaatgttggctgagctgtgctgatgaagccaagacccctcccatgcagtgagtgggccgtgttcactcactgtgcatggagtcaagtggttttggagaacatggaactagattccaagattggaggaaaaaagtcttttgggggttccactttgcagtcaactcacattcagaggcatgacaaccctctccagagagttattcttgccactgtgtttacagaggtgtttgttcgtattttctgccagtcatggaacctaaaaggttatatcatactgccttatgttcctagaaggtctagtttaccatcctaaacacaccttgtgaatcccctttgttatatttttattggaccttaaaaaattaaagtggaagagctaaaaaagtgagacaatgaacaaatgccttgagtgccagccctggtactcttgtctgtttgcatttctttgggaaaggttgtttaaactcttaggactttggttttcttctgtaaaatatggttaatagcaatttcctacgtacctcactggattactgtggcaatcaaatagacccttgttaaatagatgagaaggtacttcagaataaacctccatacaagcacagtgagttcccctaattaattcatatttcttaaatcagccaaaatacctatttccaggaaattgaaaaatagcttgccagactttctttggctttcagcaatgtgagcagggctggccagagagccgtgcagtctgacataccagccttgtggtttagtttcttccggatacctgtgcttagcacttttgcagggcagctgacagggtacaaagtccatgtaagcaagtggcaaagcaggatgagcaggaaacttgacagattgtagataacattgggaacttcttttttttaattctgtattttgttcactcactgtaaaaaaaaaaaaaatctatgacttgcccacacttttctaatttgaaggtcatgtttgtgtgtgcatacaagtgtgtgtgttttctaacttactctgtttattgggcaggggctggggtcggggactgtaaacagacttcttaatgagctttatcccaaagaatccacccttacttctcaggtagaagttatttttaaatgtgtgctcatgggtaattggtccagttttatttagaatggaacctcgcagtctgtggcgtgaactgaacctacatgtgaccattctcttaaaacaagcaaggctgttcagggctatgccaacttgaggctgtcagaacctcccccacctaggccaccctggccttttctccctaggattaggatcttgtcctgcatttccatttacttagatgggtctgacatagccaacaggctcctgccacactgactgagtgtgtgagccatttaagcagacacagaggttgtgctggaactcagatgctggctatggctgctgaggctgcagccagttcaggcctcccacccactccccccagtccagccctggagacccttgtggtcggagtcatgtctgcaggaaggcttcttgtctgcctacccattcatgggcagaagtgccagcacacttcagggacccccgaagcagagcccaactctttctatactgcttagagaagcccagagtgtgggctcgcaggccagttccagggagagaacaagaacaggcagggttgtgcacacccagcagctttgctcattctcaccaatcagagaaatcgtacctcattccacggggaggagggtgagggcaagcaagaagatcaggtgagatttgccaggccttccaatgccagaaagtcctcctcaacaggtcaaggtaggaatgcttatgggatgagaaagtgtttccatctgttatcatctaccacgagatagtctttcctacagcctctatcgccaagtttcaaatccactccctgcccttgtactgttgttggatcaaaggacacatatcattcacgtgacaatccagtggagagataatgtgctttgatcttggcaaggcactagaccaagtcttttgagacaccctcgtggtggttgggtggcgggtatacagctctactgtgggcgccactcaccttagataacagcgtgaaaggaagacgtggccaagcaaaagaccaccagctgtatctttatacatattaactgagactaaatgcaggctcagctaatgtgtacagttagtacacattgtgtaactcattggaaaaccatgctcaatggagcactgtcagtgtgagcaagcaggacatgggctcccctgttattacagttcatcttcctggttttggttcattcttgtctgtgaggattatttggatttttagtttatcatctaattgatcaacaccaatacctaacagctattgagtgcctactctatgccagttctataaagaacatcttggggtcttggtgaccccaaactcagacttagctgcgctggcaacacaggaagtagagcagagctgtaagaaggctctgtggcttagttcactgtgggaagccatttcacctctctaagcctagttttctcatctgtaaagaggccatgataatagtacctgtgtcataccatttacacacatatgtacacaaatatgtgtctgtagacatttagcagcctagtggctggtgtgtagacagcactcagtaaacatggacacaactgcagagagtgtgaatggaggtctgagctccaaatggccagggtaaggacctggtctgactgtgtcagaacacatgaggactcaacgtgctgaatcgtagaggcactcacacattacctctcaagccaaggctctcaggagcctcaaggtcaccatggggattggacactacccctccaagcagaacagctccactcttacctactgggtacagacagagtgtgtgtgcatctgtctctgtctctgtctgtctctgtctctctctctctctctctctctctctctctctccccccgccttctctctccctctctccctctctttctctctccctctctccctctctttctctctccctctctccctccccgccctaccccatgtctcagggattctcagttgagggagatcttgtccctaaggggacgtttagcaatgtctgaaggcatttttggttgtcataacctgcgtggggagcggactgctgctggcatctagtgaatggaggccagggatgctgctaaacatcccacagtgcccaggacaaccccacaacaaagcactatccagccccaaatgtcagtgatgccaggttgaggaagcctgctctgcgggcgtatatgtatggcggggcagggggattctctgcatggcttttatttggtaaaagtctaggaaaaaatagaagatcagcgttatatagtgtacctggaaaaaaccacctgattgctaagcactctgaaaaaccacatcccttaggagaacccgagtgtggggcctgagcccaaggccagaggggagaatagtctgcagagagtcgaagcaccatccacaaagacaaggtgtcttgggagttctgagttgctccaggcctaatggcatgaggacacagggaagccacttggccaatatgaaagtccacatgccacttgaggattcttttctccttcaagaccaagtttaatattgatctgatcatatttccccttattagcaggatctgatttggtaactctaagcctctggtgaaaaatcgtctttgaatatcagggtgatttgccatttttattgctgtttttatagatcaaaaaagtcagatattagcaattcatggttcaacctgctgaggattgagggtgatgacttgtaatttctgtatacattactttatatccttcctagaggaactctgtacaaatgcccacatccctgttcaaacctctagggaaactgggcatctcaagctaagctgttacccctgtcctgaacaagcagcactcaccaggagcccagcctaggctggcgtacctgtaacggaccctttcccagcagacataagacgagctcctgtgttttaaccaagtggcttgtcctcaccttttgcatctgcccagttgggagaagagagattcttttaaacctgagaccctccaaaaaacaccccccatccccatctcttggctgtgttccttggcatttaaaaagaaatggggaaccttgaagacttgctaagtaaaataagccagacataaaaggacaaatactgtgtcattccatttatacgagtcacctggaagaggcacattcacagagacaggaagtagaagggtgattgccaggggctgaggggaggggaatggagagttgaacgccactgaactgtacacttaaaaatggttaaaatggtaaatttggtgttatatatgttttgtcacaatttttttaaaaggagccagcatgttcattgccatatgctgaaaccagattcaaccctgatgttcacctaaaaagagggagtagggaagtgcctaatactccatctttacattgtcatgaaacctaagtgagattaggacatggcatcatcagctgggcttcttaaaatgtttccctttccaccagggccgtcttagagagaccgtatattcctgttgggctgagagcactttagtgacttttgagtgtgtgctaagccctattttccttcctctggaaggatgaaattgttcagcttgttggaactaggtgtcttaggaacagagagctctgtgttcaggcccagtaatcatcctctggcatattttttgttttccaggacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcaggtagatgctgccaccgtgccttggctttcccaagacggttctcctcagacccaatccacgtgccattctctcatgttttggggagggaaagggatttttctctggggacaagtgcatcccctcgtgcagctttcttgggtttgcacgttgctcctgagttctttccttcagtcttctgagggtcccctggaggaaatctagaggctgactccactcatggctgtggaagctcacggggatgctgagtaaaacaggcctgcatctgcacctcacgcaaaagaagatcttcctttagactttcaggcttctatgatgcagtgagttcacccagatggtggctgctgtggcacttgctagtgaccttgtctttcctcctcatgtttctattgtcttccactgtaaaatgcgtccagggttccagccagcccatgacagcttctcttgcttggtggtcgattgtgctagtctggacggcatttcccatcaccacactgggttggattttttttcacttccaactggcagctgctgtgtgagtggaatcattatattcgtttcccttgatcttttcctcttgatgcctctcctctggtgcagccttggggaagcccacagcaggcaccactgatgcaggagaggctgcgaagatcttggctgaaaagagaagacaggcccggctgcagaaggaacaggaggagcaagaacgactggagaaggaagaacaagataggtatgctagtgctcagaatttcggtgtgatctcatgtaactgttgtgttggaaagagcagcttgcctttctttttacagcgttggtattgataaaacttgaacagaagtatgggaacctagaatgtctgaactacatggaaggtgttcaggagactgagtcttatattagatgtaattattaataacaatggaactttgttcttttcggaggacctggaaactcatagctcttggatctaaatggcacaggcatcttcccattctcctcttggactttggggccaggcaggcctcctagagctatcagggaagtctgaactttgtttaaaaaatgagattctccctgggaaaacaagaggttcaagattctggttttggtcttgattctgatttccaaattgtttcctccgtcaaattatcctaactcacaccccaaagtgagagacagaggggagggttgagcagtgtcccctaggcatagggttgtgtgtaggggcaaccgcatagtctaagaacagtgaggtatggggagtcccatctgggagcaagacaaaagacatcattgcagtggtccctacaccttgaagagcatcagaatcatccggggaatgcagtaaaaacacatggactcagccctgttctgttttagtagcttgccagggtttgagaaccactgtgatgttagtaccagggtactttgtcacaatacagacagaccttccttttctgatctttttatttagagaggaaagcatgttgaaggacaaggtcgattttatcattaaattgataaaggaagccgttaggctcatcacagagtacaatccaatactgtttagagaattatcatgacaggaagcaggcaatgctgtagcacttcaaggccagcaccgaatttagagtaataaataatagaatattattgatcctttagtgaccttggtaagtctttgtggtctctgattacaggtttgctgatctattttttaaaagggacagtggggtaggtctcgacagtcccttcttgaaatttgggacttctttgattgttttcctgtttccaacattttggtcaatacagacgtgttttgtttgtttgtttgtttgttttgtcgagtggcatgtttgggctggtttgggtgggccttaaggtgtgtgaagggaggtcacaagagataaagatgaatcacaggacctcagatgacaggccttgataattgcaggccatggagataccatgtaggctctgagctggtgagtaacatgatcgtagtcgtgtgctaaagaaggtgatgttctttactttccagctaccaccgtctgtatctcccattttcttcacagcccagctcctgaaagacttgattgaacattctgtctttattttctcaactcacattcagtcttcaaacctcacacctaccactcctcctcgttgcctaactactaatcagtttcttggttggctttggccttgtcaagcttgcccttgcttctctggcctctccttcatagcctcctctgtctgcccctcatccccttaaatgttgcctgggctttcagcccttagtcctggaccagcttctctcccaacaagctctcccgaacagcactgctcccgcctgttctgccagtgtccctgccatcctgccagtttcctatggcgtcaaaagatttagggcccacattttacacaacagctttctgttgagcctttgttgtgctaaaccagctctgctctcatctcacttcccaccttcattttccctttgtcttgttttattgtccgtttctgaagctaactgcagcttgctttctaaaccttccatactttctggaacaagggaggcactaataacacatgtgtactgatgactcctaaaactatgcctgtggcccaagctctgtctagggctgcattgtccactatcagaccctctaggcacatgtggccaccaaaatatacattcagtaaaattcatttccccagccacacccgccacatttccgtgctcaagagctgcatctgagtagatgtggatccacaccacattgggcagcacaaatctatagattgttttcctactcaacagaaggttctattggatagcactggtctagaacctagagactgtatttccagctgcaataagttttcgtttgagtgtgtcccatatacatctcaaatccagcatttccaaagcagaacttagtattttttccccaaacttcccttctctttcatgagctctgtgttcccatctcctcagacacccaagtgaaaagtctcagtgctactctcagctctttcctttccttcttcttcccaatggttgtcaggtccagtcttcatcagctgtcacattggcatctctgttctctcccttcccttcccgtccctcctctccttcctcagctccagcccccatcgcttctcacctggactgtatctgttatatcccaactgagctccctgctctaggtctcctagagtttgtcccctgtccacgctgggcccacactgacctttctcaaataaatgtgattgttctcctgtcctttaacaagccagtgactcccctgcccactggatccacccgaacctgtcaacaggccttcaaggcctgccgtgaactgaccactacctgcctcttactccttgctttcctccagacaccagtgtgcaaagctccctgacattcacccatcacacggctccacacctccaaagctgtgcttttactttgcccccacgtggacttgtgctccttcctgccagacacctcttcatttctcaaaatgcaggtcaagtcttgctccctccctgtaccttttctggccctgtgcctgggacagaactgaccaccccccactcttcacccatactgagcccagctgttcagttgactaacatagcttcatttgtttacaggcctcctttccccagttagcaccttaaaaggctgggacatagtctttggatcactggtgcctggcgctcagtaaatgtacaagaaaggaacagaaggaggaagaatcctgactaagaaaccatcgtagtagtaggttaagagaacagaagggctaaagtagtatggtgaaggcagacatgcaaaagccagtctctgtggacttacacaatgccaaagaaatgggcagatttgaagttgatgctgaggtttgattctaaggtcttaggagaatggtacacccaataacaggtaaagaaaggacataaggaattggttttaaaagataaaaattattcatttgattttaggtgaggttatggtgtctacagtacgtccagatgattggagatggaattgaaggttgggggtgtaggtaaaaattagagcaatacactcgaccccaaatgagttttcctctctcttgccagaatgtgaagctttgcatagtgccacgtgggaggtgaggagtgaggaaggaaagtaccagacaacctggggctggaacacagcggccacctcttggaataagatcatcctcacatctgttttatgtttacagttaatagttaaagccacagaaatgttgccagataaaataatttagagaaaaataaagttacttgagtc

SEQ ID NO: 928 - DNA, 355549 bp, mus musculus
ccggcaggcggagctgcaggagcctcgcggcagcgctgaggaggaggggagagcgggcggcgcggccgcggctgccgggcgctgggctgggcggcgctgtttttttttttttttttttttttttttttttttttttttttttttttttcgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatgggtgagtgggggccgcccgcgtccgggcgtccacttcagccttgagggcggcgcgccagtcccagaaccgcggagcccgggagggcgccccgggggcagggtccggacgggggacaccgcggtgggcgccctcgcctgcctcgcgcacccccattcactcccacttgcgcccgtgtgcccgccgagcccgcgcgcggcgccgacgggaacccgcgggggcctgagcagacgatcacgggggctggccccgggcggctcgggctgagggatgcagggggtgtggttggtttttcgggtgggcggggagagttttgtcttggccatttttgcacccgagcgcgccctcctctgcgctgcggacacgggcacccggacctggtgggctccggccctgcgcggggctgctggtgtcttcctggtcctgtctcgggggaagctggaacctcggggtcttggagggggctgggttgcctttgctgggggttgacaggggttggggggtggggcgggaaacgccccagttcctggtctggctcgcagtcccggggtccagagcacctgacgctcctctccttgcgccccccttcctcccggccccgaccctttcgctgctgccttcctccagcctggcgagctctctgctccgtgatgctaaaaggccacttcccatactgtcctttaagtcttcagggtctgggacctggaaatggtgatccggtctttgatttactgagtaaacatcagttcgaagtagccaactaacctttgaaccccctgggtcccatttgatttagaccccggagcattggaaccaccttgctgcccagagaagctgccactttattggcaaggcacttatgattacttgggctattaaatgtttggtctacccaggtaatgttcttgctgacagccagcttctgtttttcagcctctggcagattatttttggatgttcctaggccaggcataggaaggctgcagataataataaatcataataaagtgagacctttctgtgttcaggtaataggattccagtacactagtcaggatgttcagaaagcctgaaggattggaaaagaggaggtttaacccagtccgttgttgacaggcaaagttaaaatcccatttgtggtcatttgccaaaaaaggttttccttttctaagtagtggtgatctgttgtccccttggcttaaatgtcacttttttcacagtgcccttctctcccacctgtagtctaaattggttcctgttccattttctcatacaacacctttttttttcgtagcagtattacatatttgtgcgtaacagttatctcctctactgtaagctctgtgaccatagggacagcacagtgttgcatagtttgctcagcacttttggtgtgtggcacagagcaggacctaaatatttgttgaatgaatgaatgaggggcatgaaatcctcctcctctgctggggacagaacacttagctcactcttgttttgctttggcccataagatgatttagttcattggcagaagtatatactttaaaccttacaggccactttagtaatgggttaatttctcccgaggtaaccaaaaattctgttttgatcacctttcattttgggtgggtcaccgagagggttatgcacaaaaagaagttaatccaaatgtcttctcccatggccagactgtgctttctgtatctcaatgagaaggggactgagtctcatttaagaagaatcagacctatttttcagatttgaactgttttcattcttcagaacttcctacgaaaaatagagtgctcctgtagtttttagtccttttgtacttaatctttactgcaaccattattgcagggggagggggcatcgattttcatttatttcaggagttaatacttagaggtgataatgtcaaaacgaatgtaatttaattcatgtttatagtgggatttaaggtgcttatagtagtttgtggctaaaaatcacctgctcttttgaaagcatctccagcagtatatttgtaatgaagtgcagttatttaacggttcattctgtatgtcttccaatggagtgatctaatgggctgaggttgtgtgtatgcagacagaggcccaccctttcccccaagtctctggttttcagatttatccagtttatcaatttgatgcaattttattcttttttaagagggagggtctcgctgtgttgcccaggatggatttgaactcctggactccagatcttcccaagtagctgggactgcacgctcacaccactgtgcctgattctgatacacttatattcttacctggcctgataatgagttttctcttgatggataacatagtaaaactgtatcttatatttcgttttctgaaaaataacagaaaagaaccaaatccctaaccctgaagtgaagctggttagttgcaacatggcctcttataaaagcccatcagaatgtgccctctgaacttgctaggagatgcatgcctacagtgccagacacagagaaagcctcttataattacaattaaacagatattatggtgacccaaatctgtgagtagtgaagggtttgcaagcccacaaatgatttctgtttaattccagagtaacaacaaagtttggatagcctttggcaatgtatttattgtattggcggtagactgctgtatgctaaactaaagctaaaatgaacataatgtgttggtctgtacaaatgtcttgagttagaaatggaagaaaaggctcccaccttaattgtacataagctttacccacttctatccatcttggcacgagcaaaagcttgctgtggctctggttacacaaaccttggtggtttcttctcttactacttcagttcttttggcgttactgacattctctcatcaactcttgagtttgtagttgtttttaatgtattttgcatacagcagtatttgttcatctatccatccatccatccatccaatgtttgttgatcttctttgcataggcactgtgctaagaacaggtgcagaacagagacatgacactttgggcttctcagtctaatgaaggctgacttgaatgcaattctcatggcagtatgtagctgaaagccatagtagagcgcatgaaagatgagtggagaaggccaatctgacttagcctggagagtgcccaggacagtgtcttagaggagattgtgtttgagcagaaatctggttgagtatgagtcatcactgccctccagccacacctggttcttgtggcagagactgaaaacgagcaccgtgggaaccgcggggcatctcagtaagatggtacaaggaaggatgacttagagggcttgcacctgtgtcaggtggcttgagggcgtgtttaaggaagctgggcattactttggattggatgctaccagggggaatttgtgattgggtattttaacaaatgttctctaggagcagggaacattggaggcaggccacagctatggttggtaaagcagcagcagtcatttgcattatccaggattgggggatatttggtcatgtgtgtggtttggacaaggtgcatgttttgtccgtgttcagacatgattaatgtgtggtcttgttttcatcttattccatcctggtcgcagagtggccttgtctgatgttggttttctagggaattgtttctgttcaacaggacaccctggcccagctgtgggtgcctggccagctcccagccagaagaactgctctttctccgagttaactatgtgacaggcaggggcagggaatcggaggcagtgggggaggaaaatggctttctaggtatatctgtggctacttcatatcaaccaggtatagcctggactgttgttcaatgctaagcacgatggacatctgaaatgctatactaagggaagagagagtgacagagaaagagcaagctgctgagaaccatgaagtcagtgctaatgggaaagacgcagaacaggaaaatagcccaaatacttagtgttagagaaggagagcctctaatgcagcgcttctcagagggtggccccaggccagtagcacagcctcccctgcaacccgttagagatacagattctctggcttcattccagcagacctcctgaatcaggaatgctggggatggggcccagcaatctgcattttcatgagtcctccaggtggttctgatcatagtccagtgtagaacccctccttgccttacagttgagaaagctgacatccggagctcgtggttcactggggtacacaaggcactctgttcataagactattataagtcttatgttataagtactgttataagtgactcattaccttagaggagaaagacatactcctacttcaaaacacacttcttgtgttaagacagtacagtgtggattcttccacgaatccagtccaacccagacctccaacacctaggcattagtgacactaggcagccgatctcagtgttagtctctgagacttttaccagagtatcacacaggcacttcccagcatcctttaccctccatcctctttaaaggggactttaagttacactgtttgcattattccagggtgtaatatttgttcatgattttctatacctggtacctgtattcgtttctgattgctgctgtacctaccacagacttagtgcctggagacatcacatgtttatcatccgtcactgggcgacaatcacgaagtcagcagagctgcattccttctggaggctgtaggagggaatccctttccttgccttttccagcttccagaattggcattcctttgcttgtggcctcttcctctctccaaagccagcaacggctgggcagctctctctcccatcacatcattgttactgactcttctgcccctcttttccatgtgtatggactcctgtgatgacattgggtccacctggatattccaggctcatctcctcatctccaggtcagctgatcagtaagtttaactcccctttgccttgtaacctaatattcacacatcctgggctttaggatgtgggcatctgggggcggggagggaatgttattctgaccactacactgccctgtggtggacctgacgtttcctggtttctcttggataactgtgtgttcatagtcaactgccctgtccctccttgggaagattccatctttggttctatttagatttttacagtttattaataaagccgccttaaagttacatcttgcattcacctttcctcttcactgctgtttttttgagacagcttgtcccactcttcccctttcctcacatagcctgccctacacctaccaggactctggcactgccttgattgtgttctagaaactgatcatgctgaggttatcctgaatgatccttctccaatcacgaagtacatggtctcaggcctcaccatgtttgacttcactgaagcttgagattgaagactggaagtctttgtcttctagaacaccctattttttcctgatttctcctacagtcctcccttcttttcttccacccctgtccacctgtggaatgctgtcatctctggtccccttatgtttagtgtgtccttgagtgattgcagccactttgccaattcaggtgtcgcctattgacgatgcccacatctgtccccagtcttggtctctgttctgagctcaggacccacccactataagcaccacaagggcaggaacctcgtcagtttggtcattgtgttcctgtgcctggtacactgtaagcctaagattaacattggttgagctgattatcattggtatcctctcctagctaacttcacccaggtgtgtcttagacgcctcagactgagcatgttgcaaactaagcacagcatttctcctctgtaatgcctgccctgcctctttttacttcccatttcattgagggtatcaccatctttcctgtcacttccacagggacgctgctattgttccttgcctcttgttccttcccctttccctgccccttctgatgtacagtcaagccctaagtggctctggaattgaccctatgtgtctacccttctgcaaatgctttagatcctgaatgccttagtgaagccttcgtgaagctcggcagccaccaatgctttcgcttattctaagctcattcaggtctctgagactttgcccacgtatttcccttcatggggaacagatgtcactctctcctctgccttgtagactccctgtatcagtttcctattgctgcagtaacaaatcactgtgaacctagtggcttgaaacagcacaaatgtgtaatcttatagttctagaggtcggaagttcaaaatggatcttaccgggtcgatatcaaggtgtcagcagggttgcgttctttctggaggaattcatttccctgccttgcccggcttctagaggctgcctgcagtgcctttacctccttcactcgtaccccagccctccaacctctgcttcagtcctggcatctcctatctttcaccgagccacctgcctgccttttatgaggaccattgtttgacactgggcccacctggataatccaggatcccctccccttctcaggatgcctggtgaatcacacctgcaaagttcctgttgccatggaagggaacatagtcacaggttctggggattaggatatggccatctttgggaagtcattgttcagcctcccacaccgcttgtgcatctgtgggagcctgctccaaaggtgtgctgtaccatactttgtttaaaacattttttatttttaatttttgtgggtccatagcaggtgtataaagttgtggggtacatgagatgttttgatacaggcatgcaatgtaaagtgatacaacatttcctcttgtattaagtctccatctccaactggatctgctcagctccattgccctggcacattgcctggcatacagtaagtgccatatgttaatgaatgaacatgtaaccctttcacccaaatacggttacaacttgcaattctccacgactatggaccaccaggagtgagtgtgcaattctgtaaagtcccctgggcagagcatgttgacaaggtctgtttgctgacagttcctggtggcccacactgtagtgggtgagaagggtgatgccacatgtattacatggctttaacaaagaactgcacattttaagatagaaaattctctctggcagtggttctgaactgggggcaattctccccaccagggggacacagcactatctggagacacttttggttgtcacagctggtggcgggggtcaggggagtggagagtcattctactggcatctactaggtggaggtcaggggtgctgctaaacatcctacgatgcacaggccagccgccccccgcaccaccacaacaaagagttatctgaccccaaatgtcagtcatgctgaggttaaggaagcctgctctgggggaaccccgggggcttattaacacagatggctggagcaccatttccttacttcattatcagtccttctggaacataaggctttgtatgtaaccacagtcttcgttttatgcacgaacctacaagtcactagagaacaggactctttgggactttcaccattttgttctttgaatggagagtgtcttaacacaactcttgcctctcttccgttgatacctaggtagttaagctggggagaggcaagggctttggggcacgaagttgttaaacttgcttctggtagtgtttggcccctgtaatgttttgtctttctattgggatgtgcttttatgtggggggacaggcgatgggtcctctgctactcacatattggtccctggcattgaagtgctggaaggagccttggcagtcatggcccatgacatcagatgatgagactgagcctcagagaggcagagtgacaatggtcccctagtggtagaacccaactgccttccagtatggaagaaccagccccgcccaatttctgtaggtgctcagaaaatgtcaggctcctgcttcccctcgtgaggctcttgctacagtctctttccgtagtaagttttttattttttattttttgagacagggtctcactctgttgctcaggctggagtgcagtggcgcaatcaaggctcactgcagcctcgacctcccaggctcaagcgatcctcccacctcagccacccaagtaggtgggactacatgtgcgtgccaccacgcccagctaatttttgtatttttttgtagagatggggcttcgccatgttgcccaggctggtctcgaactcctgggctcaagtgatccacctgccttggcttcccaaagcattgggattaggcatgagccatcacaccagggtgtaagttttttttaaacagatttattgatgtataatttgcataccatacaatttatccatttaaggtgtgcaattcaatgggttttggtacattattaattttatgctaaaacatgtaacaaaatttgcaattttcaccacttttaagtgtatagttatactgggtatattcacaatgctttgcaaccatcaccactatctagttccaaaactttctttttttaaaatcacccctccctagtaagtttctaacttgaaggtcagaatccatgtcccctgggggttcctggaccagccagccaatttggagaacacttggaagcccaaggatcccagttgagattccaaaggaagataggaaaagggaaagcgtggctttttgtgtgtgtgtgtgtttttggttgatatttccttgggaggccctttattttctctctctctctctctctctctctctcacacacacacacacacacacacacacacacacaaattagccaggcgtggtggcacatacctgtagtcctagctactcaggaggctggggcaggagaatcacttgaacctgggagcaggaggctacagtgagccgacatcgcaccactgcactccagtctgggcaacagagtgagaccgtgtctcaaggaaaaaaaaaaaaaaaaggtctacatcatgggagaaaacactgcagtgccaaacagatccctcgaattcacacacatggttgatatcattccacgtttcttcacttaaattccttcagctggcaaaggtccaccagcaacctgtgatcatgagcacttggttttcaacttgatcattatcttatggataaatatcttgcaggcagttctgtagttttcattaggggatgcttaaggcaaaaggtagctcatgggtcttaactctgtggtcaactgtgcttatatttagccttacaaagaaaaaacactaataacaaaaatcctgtgatacttgtcctaacggaatactatccagttggcaagaaaagaccagaaaaggcctctgcttacttcctttctgtggccacggaagtggtgggggcactgctggaggctggtccatctccaggtgtgggtgacagagtggcaagatgaagtgcagttcagttcatactgttatttctatcttggataaaatactataaacatttcaatgcttattaatgactcatttggcataataaatttaagtccttgagcacccaagtacagcatgtatagacagtttaaacaaccatctccttacacttgagcttcttaccagccagtatgcaaacaccagcccttgtgtttttgccagatttttctggactgttctagacttagaagacttggggccatgttctaggtctggtcctctggggctgcaccagttttagccatcacatgttacctccccatgtgaaaagtctttaattagcttagtgtcctgtctaattattccagctagttcttaggtttgtgcctggagctagacggagacgcttggccctcattttggatgaagactgggaaaggccattcttgctctgctgccccctcctcttagccagcatcttcatggacctcaattttcttcaccagggtgttctgggtgctgtcttttgatgagcattttacataatagcttctcaaattcacttgacagaagtgacttcgtaaatgaactttgcctttctcctgttttgatcatcaaaacaaaaccagcaaaaacatctcttcacaacttgaccgaaatgggacagttttaaaccacttagccagtgatttctaattacccctttgttctcaacaaactattagatggcaaagagaggtgtcaactcaaatacagtaggtcaatgagctcatctgtgatccatgaagcaggatggacagagtaagtgtttgttaattgatggtgatttttttaaagcttaattgctgcttttggctgtcaggaaacaaatgaaagtaattggcttgcggagggtggattgtggggggaaaagtgaggtggaagatttcaccaattgaagaaaaaattggaaagggggaagcagttcacactgtcttcatctgttttctggggcataatgactacagctgcttgcttgagacatttttaaagttagtttttggaataggttatatatccccaggattcgaaattcaaaaggtgaaaaagtgtttacgggaaaaagtctccctcccatctctgtccttcagctatgcagtgaccctccccataggctgctgctattttgtttctcaagttttcttccagggagctttcatatgtataccaacacagaggcatttctgttattttcccctccttttttaacgtcctgattaattgatgatgggtgaacttctgtctagctggggattttctcccccccggagatgtgcattggaacgctatgcctagtccttccatctagttttgatggagggataggtggacttcggaaaagttctccaggagactgctctattgtcctgaggctcagctgatctgggttattaattgacagaaactttgtcctggatcttaacccatctaggtgttttttttgtttgtttgtttttgttttcttgacagagtctcactctgttgcccagcctggagtgcagtggtgtgatctccgctcactgcaacctgtgtctcccgggttcaagcgattctcctgcctcggcctcccgagtagctgggattacaggcatctgccactatgcccagctaatttttttgtatttttagtggagatggggtttcaccatgttggccaggctggtctggaactcccgacctcaggtgatctgtctacctcagcctcccaaagcgctaggattacaggcgtgagccaccacgcccggccttaacccatctgggttttgaactcaggaacagtcttcccactttcatgttgtatatatagtaaggactttcttcaaatgatagaagccaagcagggcccgctaacctgagcaaaagggatgcttattctggggccacagggacctctcatgcaacccaagggtgcctgctggaggagccggaccccaagaagcagcagctggagctaggtgtgggccagctgcccagtgtgccctctggccatgcttcctccctgtcccctttcttctgtgtgacttgttcatggggcacatgccacagttccaaatgcctgttaagtgtgacttgatttggtcccagttccacatttttgttagtgagactgagcccaccggagcttctgtctcctcccacctccaccctccatatacacaggtggctgctccatgcccacatccatggtgggcgggaggtgctcagttccagtcctggtgtaaatgttgaaggagggcgcatggaggacccaaatgaagccctgccctgtggaggagtgggtgctacggggctgccctcgggccaggcactctcagtgaggatgctagaccgcctgccagtgttggcattcattttccctgccctcctcttgacaaaggagtgactgatgtgaggccgtgtggcctcttctgtgctctagccatccaggatgttcattccatcctcacagagtcccttctatgaggctccctgaggaagggcccttgtcggagccgagaacagttgtgcttcagagtaatggggctattttaatcctttgagctcctgaactgtgtgactaagctccatgtcacctattgagttggcggccgttaaaaagtgtgtctgtgcctctgggggcccttggatgggttggtgatagcatgccatgggggaagggtacagttgtgacatcgtctggcgcttttagggaacctgtgggtttttaaatggaggaagagatgtagacattgtaaaaaacagccaccgcctgacgagttaacccctgaggtagagatgcgctccagaaagcgggcagggggctctcgccctaatgcctatctcctccctcctgccttctccccctctttttctcctctctctccccctaccttttctctctctgctctttcttcatcccctcaccctttctctcatccctcactcctcttcaccctgtctccctcactttctctcatccagatccatctcccctacgctctttgtccccgcatctctctcccattcccctgcaccccctctccccttccaccctcttttccacaccccttctccccacaccttctctttccctcttagtctctctccccgcatcctcactgtccacccccagcctcctgaccctccccacttctgctctcccttcctctcagcccctctgtgttttgcccctttcttcccagcccgttcctcttattttctctcttcctcacccctcctctcctggcccctgtgtcttacccttctcattgcccacatcccttctccactgcccccttctccacacttcctctcctgttcttactaagcccttcttcctttcttcttccccctcctgcctctcttctctcacccctcaacacctccacacccccccactttgcccccccaactcttcctctcctctctcccatcctctcatctgcccccaagcccccttttctgtctctctgcccacttctttctcccccgaccccagttctctccccggaaccccactctggccccagtgcccactctccctcaacccctcttctctcttgcacttcctcctccttcccacattctcccatttcttccttcaaacccagtattgctgcgtgcctcagattttcaatcccacagggcaggaagagccagggacagggttactggccttctccatcccacagccagccatgggtccctactctagaataactgtgatttttattttagtgtacttcttttagagttttatatatatatatatatatttttttttttttttttttttgagatggactctcactctgttgccccggctggagtgcaatggcatgatcttggctcactgcaacctctacctccccagttcaagggatccccccgcctcagcctcccgagtagctgggattacaggcgcacaccaccatgcctggctaatttttgtatttttagcagggacagggtttcattgtgttatccaggctggtctcgaactcctggcctcaagtgatccacccacctcagcctcccaaagtgctgggattacaggtgtgagccactgtgcctggcactatttcttttttcttatgaactcctcttactatcattcccaaatattttggtgtatttctttttaggttttctttatttttatttttattttttttgatagagtcttgctctatcccccaggctggagtgcagtggcatgatctcggctcactgcaacctctgcctcctgggttcaaacgattctcctgccttagcctctcgagtagctgggattacaggtgcctgccacctcgcccggctaattttttgcatttttagtagagacagggtctcaccatgttagccaggctggtctcaaactcctgacctcgggtgatccacccaccttggcctcccaaagtgctgagattacaggtgtgagctaccatgcccagccagggtttttactattaatatatacttgttgctatatgtacatgtattttatatatacatgtatatatatgtatatgtatatatatatatatatatatacatatatatatatatatgtccttgttttttccacttcatagtcatctttgaagccagtgtttttagtagctgaatatttgagttcatgcatcttaatttatgtaactatttccctgtcatttgagcatttaggtagcttctatgatcttgatattatatagacgaggatgtgatggacatatgtcccctttctatcctgtaaggaaatcacactgtaggcagtgtggcattttatatccattctttatctccatagatgcccaaatgactggactggcccctgatgatgagaaggaagaagagttcagtccaagggaattggcacatgggaattggcagggtacttgtcctccatgtgtttgctttcagttttagttctagaaactctgtgttcatatggcttatcatcccttttatatgtgctctgtgtgtgtgtgtgtgtgtgtgtgtgtgtgtgagagagagagagagagagagaagagagatggagacagatcaactgatacttcttttttttgagacagtcttgctctgtcgcccaggctggagtgcagtggtgcgatctcggctcactgcaagctccgcctcccgggttcacgccattctcctgcctcagcctcccgagtagctgggactacaggcgcccgccaccatgtccagctaattttttgtattttttttttagcagagatgaggtttcaccgtgttagccaggatggtctctatctcctgacctcgtgatccgcccgcctcggcctcccaaagtactgggattacaggcgtgagctaccgcacccggccccaactgatacttctaaaagcaactgcatgtgggcttttatgttccacagcactgtccctatttcactgcaccactgtggggcaattaatcctggtctcgagttcaggtgtaagattagaggatacacagtgaaaggtgaaatccttgggggtttggttcctttgttttctctcccgctttttgccattctttttctttctttctttctttctttctttttttttttttttttttttgagatgaagtttcactcttgttgtccaggctggagtgcaatggcgcgatctcagctcactgcaacctccacctcctgggttcaagcgattctcccgcctcagcctcctaagtagctgggattacagccatgcgtcaccatgcccggctaattattgtatttttagtagagacagggtttcaccatattggccaggatggtctcgaactcctgacctcaggggatccacccacctcagcctcccaaagtgctgggattacaggcgtgagccaccgtgcccggccaccattcttttacctgactgatatttaagggaattttgtttcccagaaccatagggaaaactgtgtcctgaaggccctgagccatccatgtgacttcatgtttggctgagataggggtccaagtcccttgctggcaagggaaaggtcgtggctgtaataatccccttgtggtttctagcttagctttgtgtcatcatgcactcctctgaaaaaattgtgctcttagctttaaagggcaccacgtaagggtggctagaacccccaggagccaggctggatgaaccatctcaacgccttggcctttttaattcatcactttcagtaatggacaggattgtggaaagtattcattcttcagccaccaagtgtacgtcaaatgtcagctcatgtacctgttaaaaaaataagttgaatatttatgatgccatctcaggggcaagtttcagtgaaagttctaaagttcatgataataaatgttagaaagcattggtgctaatatgtaccatatactttatccctttgttaccttttcaaattgtgaacataacctgacttgaatttgtaggacaaacaaaacagttgactcaatactgctgtgtattggaattcaattaaattctagaagtgtttattgagtgcctgttaagcataagatctgataaccaggggaactcctcaaacatatctagagtttccctcaattgttcatttttcttaactttcatttccctaattgggtgaagattgtgatgtggtcattttatgaatcgcccaacaaaataagcagttaaaccaaagggtgtttgtttgagaaagttctatttatccagaaagaaggaaagatataaattttagcaaaacacatcaaattagaagacagctttgtgagatagaaaaatgtctagtcagtctctgaaactccctcctcactggtagtttagagagaaacaaaacagaatggggtttctcaaatgagtgctaaagttcccctcacaaggaaaacatttcccaataattcctgctttgccttaaacccactaccatgaagatcagcagtaacaggagacacggcggtgtgcttcggccgtgaggttgttgcttggtgatgtgacaggcacatactgcttgctctggtgcggtcttttgtgttcacttgcttatcccatctcttttctctcttcaaaccactgtgagaatcccttcacacagttctctctgaggccttctcatgtggtgctacacaataaaatcagttctggaagctgatatgatagttgatgtcatgtctatgacatcaaacatcattataaaatgtatagtagtgggctgggcatggtggctcacgcttctaatcccagcactttggtaggacaaggtcagcggatcacgtgagcccaggagttcgagaccagcctgggcaacatggcgataccctgtctctatttaaaaaatacagaaaattagccaggcatggcggcatatgcctgtagtcctagccacccaggacactgaggtgggaggatcacctgagcctggcaggttgaggctgcagtgagccatgatcgtgccactgcactccagcctgggcaacagagtgagaccccagctcagaaaaaaaaaaaaagaaatgtgtagttgtggactcatctcttgatgtaagaactaaaacactgctccagctctgtcccctccctcctctttccctagaggaagcaaccaccctaagtctttttaaaatcatctttcttcttttttaagaaataattttatcatttccatatgtatctcttaaaaacaaacatattgtctggttttgcttgtttttagttttataaaactgggaccgaaactgcagagacttgtgatttgcttgttgtctctgattttgcagttcatgtgtttttcctgtctggtattccattgtttgaacatgccactgtatacttaccctttctccccgatggacttttgctttgcttccagttttttgctgctatgtacagacttcccatcaccatttgaatgaatgtctctggtgtatgtgtgaagtgtatttttttaaatgtgcatagcaaggagtggttttgctgggttttaagttgctggatttccaaagtgttgtgccagtatatgttctcaagaactgagtgaatgaacaaactaatgaatgaagaagataacatattcatggaaggagagagtatatgaatattcagctttagaagagaatgcctaattgattttcaaaatatgtgttcctagagtgtaaacatctctgctactccctgttctcgccaatatttggtatcccagatatattgggatataggctaaactgccatcacagagaccccaagacagcatagctgtttccttctcaggctactgcctcctgaccactggactggtcagggtgagtgaattgctttgctcagattccttctctcttgtggacatggtcggagctggctcaccagcactgtgtccacctttcagcccatggcagagggaagtagacggggagtagcttctcttcgttaaggacatgacatggaaactgcttacatcacttccacccacaccccattgcaaagaacttagctacagtctcacacccagctgcaggtgagtctgaggaaacaggctccagctgtgtaaccatgtgcccagcaaaatctgaaggcagaggagtattaatttcctattcctgctgtaataaattaccacaaatgtaatggctgcaaacagcataatttattgtattctagtttgtgaaatcagaagtccagaatgggtgggcagggctgagtgccttctggaggctctaggggaggattcctttccttaccttttgcagcttctagaggtcaactgcatgccttggcttctggcctcttcctcacatcaccctgacccctcctcccttcatctcatttccttttccggctcttccatcttttaaagatccgtgtgattacactgggatcagccagttaatccaggatactgtcctcatgtcaagatccttaatcaaatctgtgaagtccctttagccactttaggtggcatattcacaggttcggggaattagggcatggacatactttgtggggattggggagcattattctgtctaccgtaggggaagggatgggttctacagacagtccctgacttataatgggttgattgaatggttttctgattttacagtggtggaaaaatgacatgcattcagcacattcctcatcatgtccccataaacccatcgtgagttgaaaatatcctaagtcaaaagtgcatttacaacttaggatattttcaactcacgatgggtttatgcagatgtagccctgtggttagttgagaagcatctgtattttttaaaagaggaaggggataatgggtactagagagaatgatcagtttctgccatatcataccatcgcatttttgccaatcacatggctgtggatatattttaagtgttaagttgtcagaactggtgaatttgctgaagagaggactttgttttctgatactttgtgattgtcgggattcaaatgttgaagtaatcctaaaaaacaaagcatatttttgaggtctttctcatgagtgacaatttcatccatcagtcttctgtttgccacagtccttttgcggagggcattcccatccactgttgtacttgtagcttcctcagcgaagctaacagagcagctagcatccctaggattaaatgacaaggtgcgtattaagatcccggcgcacagtaggggcccagatgtgttacaaataaacaataacaaaagcccacactagcacatcgtggccagagccgccttgtgtgcaataatcacctcatcatacattgcatgcacatagtaggtagacaaatcaaaccctcctttcctaataccctctggccctccagcttgctgtggactggacgtttgcatccccctcctattcattcctgtgttgcagccctaatccctcatgttgtgttatttggagatggggtctttgggaagtcattacaggtccctactcctttaggcagctcgatttagaagtctttttcttttttctttcatcaatttttttttctttcatcagtcactttcttctgataatgggggaggttaagtcgctaatttgtcaaatttatgtgcactcatttttgtatataagataggacaaactttctgtggtgataacttaggagtctgcaggggccagcaagactcatttgtcctttcctggatccagcagcaccatcctcggccccttttcattgcctccctgggcttcactaagactgtgcttggacccttccttccttccctccatgttgtcctaggccctgtcttgagaaatcttggctcttagcctggagctgacaaattcttgcttaggaggtggaagagaatcgcatgtctgactaaaataattcatacacactgcagttgcaatttcactttcctggggtttataaacaggaagacaccaccaattggggatgagttatttatttttgaggggggttcgtgagacatcttatttatctttgttttacttggtctgctggaaaatgcaaggaaatccgatttgttgtagccagacataattccctcttccctttcctccctccccacccctaacttggctgcttcctgaagcacaggagaagggtcaccacttgaggagaaggcacatgctggttcaggaagccccagtgggttcctgcaaggactccaaaaattatgctctgtgagcactagtttccctggcgcccaggccaagaccacagccttctcaggtcttcttgtctatgccggtatcactatgcctggcacagtgtctcaccaacaggcagcgaaagaaaaattttgttgaaagagtgaaaacaacatgtgactttaaagccagagcctcattttccccaaccagttcagaaatttaatgggatcgcatattgacttctgctcgagtgcatgttggctatggttgaggcgaccgagaaagccagcactactcagttttccctgctcttggccttgtcgtgttgtaaggtctgtttacgtttggatagtatttctctcaagaggcctaaaatataggtaaaatcatcagtgacgccatccatgggagaattttggcaacacaacagcatttgtgcctagaccacttctgctgtatgtatgagaatcttcctgtggcctttgattagccgttaacagaaatttcttttttttcttttctttttttttttttaaagagacagggtctcgctctgttgcgcaggctagagtgcagtggtgtgatcatggctcattgtaccctcaaactcctgggctcaagcgatcttcctgcctcagcctcccgagtagctgggaccacaggtgtgcaccaccatacctgcctaatattttaatttttttgtagggatggaggtctcgttatgttgcccaggctggtctcaaactcctggcatctcggcctcccaaagtgctgcaattacaggcatgagccaccgcatccagccctcagaagtttcttttgcattgaacttgccaagaaaagacccatttatatgatcagccccttgtaaagcgcgtgccctgtcttcagggtagctgaggggctagcttgttttactgtcccctccaaagtttccctgccatggttctaccatagaagaaatcttctcctttatcttccttagttgtggtcagctttcaggcttgccacacttcctcctgggtgagtaaagaggcacatttgggtgccctgggttgggcacagtagatttgaggtaagggagccagagtgctcatttctgcagcagggctctcatcctgcattttagggaagtgtctctggccccctgcaatgcgggatgtttttcttcttttttcctcttgctttatgttagcttgaaccagtccctggtgttttgcttcaggattcttttcttcctccctagggagtaattgcttagaaaatgccctcctgtcaaaaacacaaagtcttcaatgtcataaattggtagtggaaactcctccgtcatctggcttaatatttgaactgttgctaatggctaagagattgcagcatgaaggtgggtccctttggaagcctgttgggtcaactggggtgttggctgtctcctttggtcagtgtgtgtacagtcatttggggaccagcccattcatcgcaggcacttcaatcttttaatgctctcactctttgaagaattataggagccatatgctgcttcccaggtaaccgagacttgctaaaaatagagcttaaatggccccactgttctggcattggaaatcgttgctttttatttttaggccagcttgtgtgatccgtagctactttcaagcttgggcaataagaatcactgagcaagacctttgtcagttgaacactgttaaggtttgaacctccactcccagctagttggaaggagaatccaaatctattgaaatagggagtgctgaccttcacatggctcccctcctccacctccaccctctattaagcaggattctgtttcactgtgggtttagggtacttaccacaagaaaaatacgttgcaaagaatgaattctggctgtgagtttatggcaccagccaaacaaccagaagaacagactggcataaaacagctttgaggccattaaagaacaccaccaaggccgagacccatgcactgtgggttttgggtggtctgaaatggaaattgtcatcaccatacttaggtgcagattaatgcattaaatgataaataagaataggcctaacttccattgctcatttcataagtaatagtctcattttactatccccattcttgcccaccttcagttacagaaataactctgagtgggtttgctttttaaagatctgtgtcaagcagatatctcacaaaaatggcacaggcaaagtgttctatttagaagttgccctgtgacacaaaaccacagtgtgttttcagtccttgggcactggtttctttggacataagtgctaggggcatggtgccggccttccgggggaagtgacttgaaagtgctgtgggctccgcatagagagttttacttcattaacagtcgcttatccgtcaggtccaaaagacgcagcggtggtactggtaaccaggtatattcgtttcctattgttgccctaacaaattaccataaaatgagtggcttaaaacaacacagattttactgtcttacagttctgtggtcagaagtttgatgtgggtctcactgggctaaaatcaaagtgctgactgggctgcattcctttttggaaactctaaggaaaatcccgttcccttccatttcccatcttctagaggcagcccgtattccttggctcatgaccccttcctccatcttcaaagccaccaacagtgacccaggtccttttcaggttgtgtcacttgatcttctctcctgtgcccccgctctctttttaagaacccttgtgggtacattgggtccacctggataatccaggcgactcttccttttgtaaggccagctgatgagcaaccttaattccatctgcaactttcattcccttttgcttgggattgggatgtggaaatctttgcagggggtgggggggtgttgttctgccaatccacaccagggactttgttttcctaaatctccatgtcgggtagggccaaaggggcaatcattttggtggcagcctacgtggaagatggcttctatatttgcagagtttcaggaagttgagagggtttctcttagaccactagactgtgaagtttgtcagataccttgtttctctgtagggtggtcctggagttttgatgatcccagctgagactcttaccaggggctgctagagcctggggatggatggctgtgaaggggagcagggagttaggatgactggtagcagctgggctggccagcgagcgaggaatgaggaagcagggggatgaggacaggaaatgatagacgagtctgccccttgggagagagaaaatagaagatggggttgattacatctggccccaaagaaaataaaagcatgggcttttttgtttgtaggctttgtgattgattctactgttgagtcaacttagacgctgggctaaacaaatttatttgcttactttttggacatccagtgcactcttgccactaaaagcctcaggggttcattgtggccacttggtgtcccgagggaggttggggggtgttgggtgtcactgtccaaacaactctctctggagagagcagcagcccagctggggaccccgtcccaggagggctctgctctggagaatgtaaaccggtctggtacaggctcacagagccttaaatgtgttctcaagaattctaacaaataatctgttgtgaacttaaactggtttggactttgaagaactgacaagttcttttgagaaatagtacgtgggagctttgtgcatcctttcccacggtcccatgactgggaggtatgttacagtgaaagcaagtctcagacacgttttggccactcattcagacacttgttagtaagcaggcatgaagagagccctgctttagctgggcgtggtggcacatacctatagtccctgttacttgggaggctgaggtggaaggattacttgagctcaggagttcaaggctgtagtgagctatgatcctgtcactgtactccagcctgggcaacagagcaagaccctgtctctttaaaaaaaaaagagagcacactgcagtctgttttgtaagctcagcaaagcttgagccctctggccgggccccttttgggaaagagacattcaaggcagatgccactgtattccagtgccgggattcagctaacccccagggaggggacagggtcctcctttagtggttgacaatggcccctgacagtcctgggcctcttctctgaagggggcagactgctgttatttctagattcttttgtgcggttcttctgaggatggagatggtggcacaatattttcacccaattcctagagcagagggccactgcttgttttcatcatgctaattaaccaactctggtgcaaatggactctgattagtctttcaaatgctgatccaccatccctggagtgcttgtttttcatttggatacttcaattgtgagctgacctcttttaggataaggatcaaagccaagtaatacagagctatatgaggagacttcaacaagttcatggaaaatgggtattatgaaaaaactattcatggatttaaatttttttttttttgcaccaaaataaactcacactaacttggctgtaacatgtctgaatagtatctagtttgaggcactaagaaagataagacaccagtttggaaagagcccctatcagagcaacatgaattctgctaaaattgaagcaagaacaaacaccaaacttatagtgaagcttgagtggaagaatggtgaaataactgatgctttacacaaaatttatggggacaatattccaaagaaattagcagtttacaaatagatagctcattttaagaaaggacaaaacaatgttgaagataaggtctgcagcggcagactatccatatcaattttcgaggaaaaaatttatcttgtttatgccctaatagaagaggactgacaattaacaacagaaacaatagccaacaccacagacatctcaattggttcagctcacacaattctgactgaaaaattaaaaccgagcaaattcaatgggtggcaaaaccattgctcccagatcaggtgcaaacaagagcggagcttccagtggaaattctaaacaggtgagatcaagatcatgaagaatttattggaagaactgtaacaggagatgaaacacggctttcccagtgccatcctgaagacaaagcacaatcagagcagtggctaccaagaggcggaagtggtccagtcaaagcaaaagcggtcaagagcaaaggtcagggcaacagtttttggggatgctccaggcatgttgcttgttgacttcttggagggccaaagaacaataaaatctgtttattatgacagtgttttgagaaagtcagagcatgagcagaagaacatccaggaacagttcaccagagagttcttcaccatgacaatgctcctgctcattctcattcctcgtatcaaacaagggcaatcttgtgagaattttgaggggaaatcattaggcatccacttcacagtctgtatttggctctgactccttttttgtcctaatctttaaaaaaaatctgtaaagatcacctattttccttcagttaataatgtgaaaaagactgcattgacatggttaaattcccaagaccctcagttctttagggatgaactaagtggctggtgtcatcacttgcaaaagtgccttaaccttgatggagattatgttgagaaataaaatttataattttatcttttaattctattttccatgaactttttgaagtcctcatatagtacactgtttcttttttagtgtggattgctattttttttattatttatttttatttattttttatttatttttttgagacagagtcttgctctgtcgcccaggctggagtgcagtggcgggatctcggctcactgcaagttctgcctcctgggttcatgccattcttctgcctcagcctcccgagtagctgggactacaggtgcctgccaccacgcctggctaattttttgtattttttagtagagacggggtttcaccgtgttaaccaggatggtctcgatctcctgacctcgtgatctacccgccttggcctctcaaagtgctgggattacaggcgtgagccaccgcgcctggcctgctgtttttatttttaactttttattttgaacaaactttagacttatggaaaagatgcaaaaatggtatagtttccatatatccctttcccagcgtcccataatgttaacatattatataatcatagtactattattagaatcaggaaatcaacattgctatcatactatatatctaaatgctatatgctaaatactatactatgctatactatatctaatactgtactatagatcttgcttaatttcatcagggtttccactaaggtcctttttttgtggttgttctaggttcctcttcagaatccgtgttgcatttagttatttctcctagtctcctgcagtctgtaacagttccccagtctttcttgattttcatgaccttgatgcttttgaagagttattttgttgagtatccctcaaattggattggactggggttatgccttttaaaaatcatggtaaaatatacataacataaaatgtacgattttaaccgttttaagtgtacaattcagtggcatcacgtacattctcaaggttgtgtaaccattatctgtttccagaactttttcatcatcttaaacagaaactctgtacccatgaagcagttacttttcattccccctccccccagtccctggtaatcacacttgtactttctgtctctatgattttgctgttatgggtacctcatataagtagaattatacaatatttatccttttgtgtctggcttctttgacttagcttttgaggctcatccatgttgtagcatgtatcagtacttctttttttttttttttttttttttagaggtgggatctcactgtgttgcctaggctggagtgcagtcactgttcacaggtgggatcatagtgcattacagtcttgaactcctgggctcaagtgatcctcctgccccagcttcccgagttgccggggctacaggtgtgtgccactgtgcctggcctgttcctttttaaggctgggaataatattccatagtatggatagagtacattttgtttagccattcatctcttggacacttgggttgtttctaccttttggctagtgtcatttatgctgccatgaaaatggatgtatgaatacttggttcacattttaaaaggaacttggagaaactggagaagagacagtttggagcaggcagaaaaaggcactattttgtgtttcccatccctgactgaggctttcacagaagcaagggagattgagatgcagtggggcagggagatggcaagtggactcagagacaggtgccagatggttgagaggccaggaggggacagggagcccaacctattatacttgtccaaaggtgctgccactaggggaatgcccagaaggtgcaaacaagcccactggacagggtcaaaggcctaggaaccagtaggagaatgggttaagaccacgatttgctgcagaaagcacagtttgctccacaccacccagagccaggcaggatggtataggcatgggttgggttgaaaattaagtccacttaatatttcttcttgatgtttttcaaatttgggggactatcttccagtaagaaatatatcttaccttgcagccttgtaaacacacctgtctttagttatgattgaaatagtaatttcaggctgggcatggtggctcatgcctgtagtcccagaactttgggaggctgaggcgggtggatcacctgaggtcaggagttcaagaccagtctggccaacatggtgaaaccccgttgctacaaaaatacaaaaattagctgggcatgatggcaggtgcctgtaatcccagctactcaggaggctgaggcaggagaatagcttgaacccaggaggcagaggttgcagtgagccgagattgcaccattgtactccagcctgggcaacagagcaagactctgtctcaaaaaaaaaaaaaatagtaatttcacaacaaacatttgatgtgctctcatattttctatgcagttctgtttcattaaaaaatgcttcttgtgacctgggttcctgggttgccttcatcttgaaaacactgtactacacaaagcctcatatgcgaagttctttctgccagttacttttctttctctatcaagtttttgtccctttccagttggaaaatgtaaaccatgtaattgatcacgtttctctttttgttttggctatgaggcaacacaaaccttggcttgaccaagcgataggtttctatatggcggtcatatactgtacatactgatgccttaacttttcctagctcttgaccttctagctatatttttcctgattctaattggtcatatatttttgttttgttgaattcttgggagctgccacaaatctatatggagtgtgatgatggaatatataacaaatcatggagaacttttgatcttgactgagataaattgttgagtaaagtctgcatctttagagattttgtttttgagacagggctttgctgtgttgcccaggccggagtatagtggcatgatcatggctcactgcagcctcgaactcctgggttcaagccatcctcctgcctcagcctttggagtagttgggactacaggtgtgtaccaccacacctagccaattaaaaacagtttttctttttgtagagatgggatctcactatgttggccaggctggtcttgaactcctgacctcaagtgatcctcctgccttgtcctcccaaagtgctggtattacaggtgtaagccactgcacctggtgagattttattttttttgtgaagcacggtctgggcgatatgattttcttttagctttatgattctccggtttacttttctggcttttgtttcagattacctagaaagcaacctcttcctttttaatttaattttatttattttatttttattttattttttaagatggagtcttgctctgtcaactatcctggagtgtagcggcacaatcttggctcactgcaacctctgcctcctgggttcaagtgattctcctgtctcagtttcctgagtagctgggattacaggcgtgcaccaccacacccagctaatttttgtgtttttagtagagacagggtttcgccatgttggccaggctggtctcgaactcctgacctcaagtgatccacccgcctcggcctcctgaaatggtaggattacaggtgtgagccactgtgcccagcccctttcctttttaaaaaaaggaatttatcatagtggcaaaggtagaattcaaggaagtttggaattagtgtggagggaaggtgtcatttcatctttaattaaggccgtttttacttgtactcacattgcatagaattctgtttacgcaggtgtttttgtttgtttgtttgtttttttaacagaatcttgctctgtcgtccaggctggaatgcagtgacacaatctcagttcactgcaacctccgcctcccaggttcaagcgattctcctgcttcagcctcccgagtatctgggattataggcgcatgccaccatacctggctaatttgtgtatttttaaagagatggggtttcaccatcttggccacgctggtctcaaactcctgacctcaagcgatccacccatcttggcctcccaaagtgctgagattacaggtgtgagccactgggcccagccacaggaatgtctcttaatcaagctccttgcttctattcccctgcctcatctcaagttcccattcccctacttgatttaccatgtttgctgtctaactagtgtgttcctgccacctgcagcctctgcccatgagtccttctgccgcaggtgtcatcagagaacacatatttatagttatacttcctctctgctcccaaacctccagttactccccagacttgcggataatgcagtcttttgagcttgtatcaaggacagagcccatcttgccaattgattagagcaccccagctttcaccctgccctccccgcctccagtccttaggttggaaagctctgagagaggatgaaatggacagaccatctgatgcatatggacctcttgagagatgatttagaccagggaggatgagtttggagttgaatccatttttaagtgaactctccactaagcaaaaaaaaaaaaaaaaaaaaaaaaaaaaaaaaaaagactagtattagctctaggggaaaagaaactagtgataggaaagaaacataatcttagtgtaccatgtggctaggcttttagtaatgtttgtgtagtcataaggatgtaaatacttgtgttagttttgtagggctgccagaacaaagtaccatggattgggcaccttcaacaacagaaatgtgttgtctcacggtccgggaggctggaagtctgtgatcaaggtgttggtggggttggttccttttgagggccatgaggttcctttcgaaggctgtagttgcctctggggaggggaagttggggagaatgaagaatgctttttttccataagagacctttacagctatttgaaactttaactgagtgtgagggtgacttgggtgacctgggtcagcatagcctgtgccgcctgcaccgagctgctcttgccttcattcgaggtgagaaaaggaagtggggatgttatcggccttaaaggtcgctactgacaagaagtgaagtcttgggctttctgaggcccgtttatcatttcattctaaaataacccaatagttactttttagctccttatatgagatctactttaagatactccaaagcagggctttttgggggagggtagtgtagtttattgcatttttgtaattcttcagaagatatctactttcttctctctgttgcagttattgatttagaagcaagctaggagcatatgacagaaactgtcagtaacccactctgaagttaattttgttttggttacaggtaatagtttcatgtctacttctgtggggaacagcagtgatagatttcctctcctttttttttttaaaagctttccttttacctgtgcaaacctctcagtctccccatgctcccatgatgcgatgggggagacactgaacacccaaatgggcatttctatctgcagaaaccctaagttccttctactggtgttaaatagcttgtggaatgtgttagtctgttaagtagccagtggaatgaatgtattaggtcatctgtggaaacaattagaagaaaaaaatctggcaaaggagcagaccaggaaagtttaaaaaaaaaatcctttctggcacgcagttcaattagattagtatgagttgttagaaattaatgtttgcggtgtcagtgagcacacttaaacgacaaaaaagaaactcagttgcagtatgtggcacatcattaaacatatactcagatgtttatttaaaaagtatagatctgtatttcttgtatgtgtagcactgagccaggtagaggctatgtgtagcactgagccaggtagaggctatgtgtagcactgagccaggtagaggctaagagtaaatgaaaatatataatacctggtcctttctcttaaggagcttaaatctgtttggaggtagcaagacatagaatgtaaaagataatgaaagggttaaaataacagtctgagacagggatcagcaaactatagcctacagctaaaatctggccttctgattatttttgtaaataaagctttatggaacacagcctcactcatttatgtttgttgtctgtggctgctttagtgctgtaaaggcagatttgaggtgttagagtggaacattggtcccaccaaagctgaaatacttactatctgactctttaagaaaaagcttaccggcggggcatggtagcttatgcctgtaatcccagcactttgggaggctgaggtgggtggatcacctgaggtcaggagttcgagaccagcctggccaacatggtgaaaccccctctctactaaaaatacaaaaagttagctgggcatggtggtgcgcacctgtaatcccagctactcaggaggccgaggcagaagaatcgctaattgcttgaacccaggaggcagaggttgcagtgagccgacatcgcaccactgcactccagcctgggtgacagagtgacatttcatctgaaaaaaagaaaaagaaaaagcttaccaactccttgtctgggataataattcaaaagatgttacaaagcagtgtatgaggagtaaaagtgatttagtgaacgctatagttagtaagtctgagaatgatggaatgacaggtggcttgaaaaagggttttgaaggtgacctcagaccaagagattggagggcactttgtgatgtaaagagttgggaaggagatttcatggatgggagcatccatggggctcttgggggaagatcgtgtggggagatggggaccaggactatccagctggacttagagccaggtataaatgcaggtgacgttgttaatgtcaaacctgtaccatattgaagcggcctttgagttccaggatcaagactgggaacttcctcaaacccataatatctttcaaaggcaacactcatttacacaatcaatattcattccagacctattatgtggttgactccaaggggatgttaacatacatgtaggcacatcgctctcgtagactggtgagtccagcttgtttgactcagtgctagttctaggtatgtttaaagaaatagctgccggctgggcgtggtggctcacaccagtaatcccagcactttgggaggtgaggcgggcagattgctggaggtcaggagtttgagactagattggccaacatggtgaaactccgtctctactaaaaatactaaaaattaaccgggcgtgatggcacatgcctgtagtcccagctactcaggaggctgaggcaggagaattgcttgaacccaggaggcagaggttgcagtgagccgagatcataccactgcactccagcctgggcaatagagcaagactccatctcaaaaaaagaaagaaagaaaaattgtcatttagaagagaggtttaacctcaagaccctccaaaggctgctaataccaggagacttgtatggacaggtagtctcccattctgtgaggacagtgttctagagagagtctttgagaagggacttctggctgttgtttttttttttagatggagtttcgttctctcttgcccaggctggagtgcagtggtgcgatcttggctcactgcaacgtctgcctcccggattcaagcgattcttctgcctcagcctcccaagtagctgggactacaggcgcccaccaccacgcccggctaattttgtatttttagtaaagatgggatttcactatgttggccaggctggtctcgaactcctgacctcaggtgagctgcccgccttggcctcccaaagtgctgggattacaggcgtgagccactgcatctgggcgagaagggacttctgaaaaggaatgttgtgtaggtgagagatgtgccagggggaagggaggaggagaacccccacccatccttagacactgtattgtccttccttccttttagggcttctgtgctgtctaccattttttttctgggtctgcaaagctccctgcacatatcctcgcagggtgtgcttccaccctttaggtacccagccctatgcagttggtgagacatcataatgtttccacatgccaccatctcccctactccctgaccaccccctccaagcctgtatcctgctgtcttggcatctgttaggcactgagcttccccactttccctagatcagtcctgccacaggccactgagctcacctcaaaatcctttctctcctacctggacacagccctggggcacctgggccctgcttgtctctggccctgcagtggtcctcattgtcacccattaatgcttccatttacttctctctcactcttttttcttttgtaaattaaaacacacacacacacgtgcacacgcacatacacacacatacacagagacagagataaaagaaaattctgtagtgcattttgcagtgagtttattccagactttctctcctcaagctcctcaaattctcttctcacctgaccctaaccaagagatgaccttgattcctgtttaagagaaggcgtcaactcgcttgtgtactctcatcttcatggctttatatcactgttgtaatgttgatccacttttatccaatgccagagaaagatacccttccttcttttttttattgttctctgacttctctccgatcatgcattcctgactcatctgcctgttgtccagcatggtgaccctgtccccgcagaccgtcagtaagtacttactggatcaaagagccattctgtctgagaaaatgtcagctaagaatgtagaagggcagcaggcctaatttggcctggtttcatatttgaacctactgcctatattcatgtgtgcaattgggtatgttcgtggatttttttttttttttttttttctgtgcagctacagtatctggaacatatgtctcagaaaatctttattgattgaaaaaaatatgagcaggaacaggggcaagaagacggactttgagtccagactggctggcggctggaatattatctgatctctctgggagttggattctttcctaaaccaggaacaataataggcaccttgtagagcgtattccagttcctgttgctgtgtgacaaattactccaaaatttagcaccttcaaaaagccattttatgcttaccagttttgtgggtcaagcatttgtacagggcgtggtagggagggcttgtttcagctctacagtgtctggggcctcggctggaaaggcctgaggtttggagtggacatgacagctgggggctggaacgatctgaaggctgggtccctcacatgttgggccaggctgggatgactcagtaactaggcatgccagctggtgtgtctcagtgcaaattggcttccttacagcatggctgtcttggggtattccagcaagtgagttggaaactgcataatatggcctagaagtcacacagcatcactttcctccactctgttggtcaaagtggtcaccagcctgcccaggttccaaagcccggggaggaagattagatttctcctgttgacagctggatcacattctagaagagctcaagggacaggagatgttgctgtagccatcttggaaaacacaattggccacagagtgatcgttacagttaaatgatacagtgaggaggataaaggcacctgacacaagattttaagagtatattttctgccgggcatggtggctcatgcctgtaatcccagctactcagggcgtcgaggcaggaggatcagtagaggccaggagctctagatcagcctgggcaacatagtgagaccccttctctacaaaaaataaaataattatctgggcatggtggcaggtgccagtagtcccagctactcaggaggctgaggtgggaggatctcttgaggccaggaggttgaggctgtagtgagccatgatcgtgccactgcactccatcctcggtgacagagtgagaccctgtctcaaaagagtatattttcatttggtaaacatttatgaagttcctactatatatcaggccggtcctgggtctacagaggcaaacaaagcagacatgctgtctgtcctcctgtagctttcagtctagtggcggacacaggcagtaatcacatgtaattagatctggaaattcctcctccttttctggacaggggctggtgaaacatctggattcgtgtgttgcattttaagtgtttttcttttttttccccagtgaatgatgaggaaggggatctgcccattgttaatgtggaacctcttgctgctgtttgttttgttttgatacttctacagatctggaggctcatagcactgaaaggtgccttgtcaggcttgaggtctgcaagcaccccctgacccttttgttcagcttcagacttatgtttctctttctgcaaaagggatttaggagagtagtaggggtacatagagtcacctgggagatcatcttcagcctagacatgacccaccctgccccccgccccattctgatgggaaccagggtgtggaggagacaggcatgagaaagtttcacaggggattctaacatctctgggtgaggaacccagtgtgagatgggccagcgcttcccaaaccatcccatgcatgtgagtgtcctggggatcttatgatgcagcctcagattcagtaggtctcggggaggctgggggatgcctctgagtagtgagggtatgtggagtaccaggcgggtacagatagagatgcctgtggaagtttgctgcaccctgacgaaagggccagttctcagagagttagggtgctgagggctagccaggtgagctaccagatttctgtcatgtttcagcacgcaattcttacagataattactctgctaaaaaccataatcacaatatcacttttacacctaaacaacgcaaacaacagccttccttatgtaaaacacatctcaagaaactcaaattcagaatgttggcagaggtggccttgtccacactcatagatctggtgtagaacacacttttgattgtgctacttactcatttttaagtagcttatatgtattttttaagtagcttatatatcccagcactttgggaggtcgaggcgggcagatcacttgagttcaggagttcgggaccagcctggccaacatggtaaaaccccgtctctactaaaaatacaaaaattagccaggcatggtggcgcgtgcctgtaatcctagctatgcagtaggctgagacatgagaatcacttgaacccaggggcagaggttgcagtgagctgagatcgcacctctgcactccagcctgggagacagagcaagactctgtctctaaaagaaaaaaaaattatagatgcccagtaccctttataacaaattcaaatattgaaacatacatatgtatacaatacacacatttaatattttgttgcctttaaaacccccatcttcctttccaggtgcattgctatgcccagcatggtcagctgaatcatttgtgaaatagtgattacaccagctagagttacgccagcataaagatttgcatgttttcagttcagtgtaggacattattcttctacttgcacatgtagagcattttaacaatccggaagtgtttcagcatatattttgtaaagataaggactcttttcaaaaccataatcacaatcatttttacacatacagcaactaacagtgtttccttatcatcagacatttaagttcaaatatccaatttttacatgtagtttaaatattttaaaaggtgtttgtttgaatcacgatttggaaggtctgtactttctaactggttggttgtctctgagtctgtttttttttttttttttttcactctgctacccaggctggagtgcagtggcagtctcagctcactgcaactgctgcaacttccactttctgggttcaagtgactctcctgcctcagccgcctaagtagctgggattacaggcacgtgccaccacgcctagctaatttttgtattttttgcggagacggggttttaccatgttggccaggctggtcttgaactcctgacctcaagtgatccgtccacctcagcctcccgaagtgctgggattacaggtgtgagctaccgcacctggcctctgagtctgttgtaatctaggttctgccatctctttttccttgcttttgttgttgttgaagaaactaagtcatttgcctacagtcctacagcctggattttgcagattgcctccttagagtgccatttaacatattttcggacgttctgtatcccctgtaaactggtggtaaatccagaggcttgatctgattcaggttccgtttgttggcaagaatattttgccagcggtgacacacacttccatcatgaggctccagatgcctggttgtctctctttttgtaatgtccacagctggccaggcacggtggctcatgcctgtaatcccaccagtttgggacactgatgccagaggatcatttgagcccaagagttcgagaccagcctgagcaacatagtgagactctcatctctgaacaaaaactttaaaaaataagccatgaaatttaaaagaaattaaaaaaaaaagctggatacagtggctcgcacctgtaatcccatctatttgagaggatgaggcaggaggatcatttgagcccaggagttccaggctctagtgagccatgacaatggcactgcactccagcccaggtgacagagtgagaccctgtctcaatcaatcaatcaatcaatcaatatccacagctgctagtgaccattgctcaggttcttgattgcattagaggttgcaaaacgttgattgtccaattctctcattccttcttcattttattagccagaatattcctatacagagaaatttctcatcaaccatttggttatcttgaattcatataggaaaggcaggacaaatgtttgattctttttttaaatttaccagtttcaaaacaatgagttggctccctagcatcttccaaaggtggccaatgatgttttaaaagtatcactgtgaaagatatatcacataacatatgagacatcaaattaatttgatgtctttcaatccagttattgttactaatgcagttattatttcagtgcactttcaatgctgtttcaaggcagttattgttaatcatgctcatgttgccccatttgtggccagtgggagcctcttcaggttcacttctgagttgttttgacatgaccctagtagtgtttgctggcctccttgctttcttggtgtgacaagatggcccaggcttatcacctttcctgccccagaaatgaaatcagccatttatctaagggtagctggctttctttttgtgaaaaacggtatttggagactgaatgtgattatttcagaaaaaaatgtatacattgctcttcatagatcattattcttaggagtcttttggtgtgaggctgttgatctttttaattttatttacttattttcactaactcatatttcaattttgggaaaggtttcaaaaattttaaacccaatccagtttatttaggttttattctctttttcgaactttaagctataaccttcaaaggaaagcaaatgttgggttttaacttcacttcttttttgtgttactctatatagacacatacttactcagtggcttcctgatgctgcaataaagtatttacaatgtagttgattaagaaaacatttgtgaagtagatacttgactagcaactttttagttcaaattattgttcaatattaaaaagtaccaactcaaatgacttacaaacgttggtagttactgtcttgatagactcccaattactatgtgacatcattggtgaaacttaggatgaaaccgtgaaatgcaccctccctaataacctgcacattatggtgttgcagatatgctagatggtatctccagattagatgtctgggagcctaaagtagttatacttatgacagtttgaaattctagactgctttgaagagctgttattttgctgttatcttctgcttttatccctgtacatttgtctcagatctcatctcagattctcagcttcttgtcaaaatcatccttgcaagtttcttgcccctcgacaacaagcatttcttgagtgcctgacggggccaagcactcagccaagcacttgagggaggaagatgcattgggcaatatgacttttctttcaggaggcccatcagcttctgttttacatgtcccttttgccttctaggggctcgcggtagcaggattactacacctgggagtataaatgaagcctgagatgggacattaaatctgccggggagaaagcagtgaggattcactgtggtttcctctcacgttacctcactgtctgctatctctcttatgagaaagtatgtttcttaacagaaggccatgcagtgagtgactcagcccttgcccacccccaaccatgctgaccaaccacatttttctgtggaatcgttcttccctccttttgacttggtccctgcctcttacagctgattcagcttagccacactgaaatcaacaggaaggcttttgcttttcttctttcatacaacatgtccaaatataaagccaacctgcccccttactatcctatcctcaagacaagcaagagttgctttccatgatagtccttacaaagtatcctgtaccataaaggctctatgaatttattttgaataaaatagttggagcaaatccttcagataccttatccataataaaattgtttcatgaaatgagagggtgttggggggtggggagcgatgttttctaattattttatttcacataatctgtaattacattaatacatagtataagcagacacttgactgtttcttcttctgttttgaggtttacatattcaggttagcccacaaccttttggatcttctcactgagaaaaacaggggatctctttctaatcaggcacttgtctttgggtcttttttgaatctgagaactaggctatcattataaagtcaggaaaatctctactcatcctcaagccattttattatgtaacactgtcaaatatttatataaagcagcatactttcttctccatgcacaaaaaaaggttatgtctttaagtggctaaacttttttgactaaacagactttttattaaattggttttctggccagatgtggtggctcatgcccgtaatcccagcactttgggaagctgaggctggccaatcacttgaggttaggagtttgagaccagcctggccaacatgatgaaaccccatctctacttaaaaaaaaatttagctgggtgtggtggtgcatgcctgtactctggaggccaaggcaggagaattgtttgaacccaggaggtggaggttgcagggagcctagatcgtgccactgcactccagcctgggcgacagagcaagacactgactcaaaacaagaaaagaatattgcttcataaacagttgtgcctagtagctcaggagactacaattaagtccatttaaaaaatgtgtttttctgagattccatgtaacactacctgaaaaaaagtagaatgatgggaattaattggaggctctaaaaactaaataagaatatcgggccaggcatggtgactcacccctgtaattccagcactttaggaggctgaagtgggtggattacttgatgccaggagttctagaccagcctggccaacatggcgaaaccccgttctactaaaaatacaaaaattagctgggcatggtggcacatgcctgtaatcccagctactcaggaggccaaggtaggagaatcacttgaacttgggaggcggaggttgcagtgagctgagatggcaccgctgcactccagcctgggcaacagagcaagactccatctcaagaaaaaaaaaatggttttctaagattccactgatttttcccctccgtgattgttgtatagaaccattctctacacaggcttatccagctttaacctgttgtctttattttttactaggttttgttgttgttgtctgcctgtttgtttttgagatggagtcttgctgtgtcgcccaggctggagtgcagtggcatgatctcggctcactgcaagctctgcctcctgggttcacgccattctcctgcctcagcctcccgagtagcggggactacaggtgcccaccaccacgcccggctatttttttgtatttttagtagagacagggattcaccgtgttagccaggatggtctcaatctcctgacctcgtgatctgcccacctcggcctcccaaggtgctgggattacaggcttgagccaccgtgcccggcctgttttttaacctgcaaagtcacctgcccactttctccattctttctttttcacttaaaaagccttcttctggtcaagttatttttatccagtctatctaatggatattctattttttgagacggagtctcactctgttgcccaggctggagtgcagtggtgccgtcttggctcactgcaacctctgcctcccgggttgaagcaattctctgccttagcctcccgagtagctgggattacaggctcccgccaccacgcccggctaatttttttgtatttttagtagagacggcgtttcaccatcttggccaggctggtcttgaactgctgaccttgtgatctgcccatcttggcctcccaaagtgctgggattacaggcatgagccactgcgcccggcctctaatgcatattcttaaaagagctgtgtgttaggtttgcaggggttaatttcaggaagcgtttgataaccctttgtttttgctccttgaggttttgttccagggacagcccctggtgaggcagaggcttcagaaggcaagtggtaggggactcaaggcccacaggtcttgtgaatgctttcccatccaggccctgcatttcattctgatctttgattgaatgcccctctgctatataggcattggttgtggtgaaggtaagagtgaaatcaagactgatcacagtaacttgagaggcctggactagtggcgtatacttgttttgtggccaactggtcatgttgatcatcagctttctctagccttcaagttaaataacaaggctcacatttgtaactgcatttctttgagttgaatggtaaggtatagttcgaggtcagtactttgtaaggacactcctggtgtcgtatggtgcactcagtcaccaacatttattgagcacctactttgtgccagacaccagacgaggaggagagggtgctcagatctgccctttaagagctcccattccagggtgtgtgtagggagggcatgtcggggaagccctcacagcatagcatgataatgacctgcaagactagcatctggcattaatggagcagcttctgtatacagtttacagatatcacgtctcacccttgccacagatcaccttctgattttaaacacaaagaaagtgggctcgagctaggaatctcaccccatgtcacacagccagtgaatgtctaagctggaatttgctcccaggcctgctgggctttctcctacacctcatgcttagaggtgacaagagaggagagatgggctgggaggctcaggttccttgggccttcgtggaaagcagcaagtgacaagagtatccttaatggtgtctgaggcaggcaatggtgggcctttctttcctctcacacagccgggtttgttttttctcttctttcttgattcatctcttttctgctttccctgctgctccccaattctttgagctgctactgggcctgctacagacattgttgaatcctgccagaggccatccagccacaggtgtgctgcctcctgcccagggagagagttcaggcccagggactgtctgtcactggggtccgtgttctgagcctgtctttgttggggaagctgatgttcagtttttaagatgcaggtcttgggaattacctgcttgttgggttgatgtcccttagtggtgtgtttgtgaagacaccaaaaggaaaacgtggctggtatgtaggtcagctttattgtacgcggagatccccacagtatctgtggccttgacctgggaaattcagacccccaaacccttcagccctgacactaatgggagggcactggatggtaagaacttggccttgtgcagacttgcatagagaagagtctgtgtgtatgtaaagttgatgtatggccaggcatggtggctcacgcttgcaatcccagcactttgggaggccgaggtgggtagatcacctgaggtcaggagttcgagaccagcctgaccaacatggtgaaaccccttctctactaaaaaatacaaaaattagctgggcgttgtggcaggtgcctgtaatcccagctactcgggaggctgaggcaagagaattgcttgaacctgggaggtggaggttgcagtgagccgagatcacgccattgcactccagcccaggggacaagagcaagactccgtctcaaaaaaaaaaaaaaaaaaaaaaaaaaagttgatgcacgagtatctgttacggttctctggttttaagtaaaagaaaccaactcttccttaactaaggtagcaaaaaggatttatcagaaggcattggggtagtttatagggtggaaggagaagctagaggatcaggtctgagaaagatggcaactgggcagcttcagggatctcacttctgagagccctggtgggggaatctgctccagccgtctccagtgtttgtcacattgctttgatcacagttgggtcctatgtcatacattggctggcagagggcagggcatgttgatggacagtcccatcaaactatctcatggtggaggggaagttcccccaaacagttcccctccctgcatggggagtgttctcctgctagggcacaaacacagtctaccacctcaatgaccgacaatctacaataataaattcttaaatatatattgtttagacttttaattttaatattattatttttttgagatggattcttgctctgtcacccaggctggagtgcagtggcatgatctcagctcactgcaacctctgcctctggggttcaagctattctcctgcctcagcctcctgagtagctgggattacaggcacgtgccaccacacccagctaatttttgtatttttagtagagacagggtttcaccatgttggtcagactggtcttgaactcctgaccttgtgatctgcccgcctcggcctcccaaagtgttgggattacaggcgtgagccactgcgcccggccaatttttatttgtaaaagctgtactgaggtataaaatttcacccattttaagtgtacagtttaatacttttcaagtaaatttacagcatcctgtaactctcaccacaatttaatttgagaatatttccgtcaccccaaaaagattcttcatacccatctgcagtccatccccattcccatccccggccctaggcagccactgattggttttctgtctttttagatttgaacatagtttttttttaaatatgttcctgactggtgtaactttttctgggtattctggaaactatgttatacatgaaagaaaaaaagagcccccccccacccccccgcccgcatcaatggtgtgaaagtctgtatctcgctggtctcaggtttctctgctttctcttttaaatccttccttctctccagtggaccataatttaggagaacgtagccctgggcttgatgctgccattatttacctctcaatgtctctaagcctaagtcatggaaccttctaggcctcagttcctcatttgtaaaattcaggaaaaaaaaatagactagatgatatctgatgttctttccatctctaatgatcagtactcatgatcttttttggtgaagtctgttttggcaaaaaattacttcttgattttctatgcccttcagaggactgaaacaaaacactaaaattaaaaatttattcttcagaattcacagaacacaataagtgcaaaagcagtaagtgtgtaacatttctacttctgaaatgattaaagcttactgcactgagacctctgtgacattgtgtatatgtgtatacagcggaggaaattaattggaaactttcattctccttcatgctttctggtttattcaaatatttattgaagcagacaggatgctaggtgaaggatttagaatcctggcaaagataagggcttttcccagatgaaggttgcagtctagttggggtaagtcagtgtgaaattatagtgaggtgaactggtcctaggagacaggaaggacagtgagcagagggaggtagggaaggactgggtcacagagcagggccacggatataccaccgccaccaccaccgccatagtgagaagctggccctgagaagctgctaggcagctggcttagccaacccacagttaaaaaccacccatttcgtctttgggggaggagacattccagcaagtttgaaggtagagataggggagggtgaagtgttttgcatttctaagcagatctcttatctcccctggctctatctttttgtaacatggggttaactgtagcattggtttttgcagtgactgtagatgtagcaaacttgtggaggctggccttttggcacagcacacagctggagggtggtatttttctgacagggagatgttcttaagttttgtaatttatggtgtctttaaatatgggattttgtttactgttatcctaattacacctctgatgtattttatttagcttaatgttttaattttctgctcatacccagaggtaatttctcaaagggtaccactttaaaaaaatcataggtaatgtttcatccttcctgcagttacctgcagcctctcgaaggcaaggaaatgggttttgggggcatagactttcttctgggctcttgtgatataattttggctgtgtttgtatcatccaagatcttcaccacctgtttgccaagtattatcctaaaccattctgttctatagagacgtgatacaagccacatgtcattttaaatgttctagtagtcacattaataaaattttaaaaaggtaaaattaatttgtataatatatttatttaacccaacagatctaaaacatcacttcaacatgcaattgatgtgaaaataatgagctatttcacattatttttttctaaacaagtctttggaacttgggatgtatcttatggcacacgtcagttcagactagccacattccaagtagtcattagccacatttgcagtgacactgtattggacatcaaagttctaaacctttcaaaggcttgcagagggcactggaaagagcccttagagtgggtaggagagacatatcctcatgatttatgagctcttaacaaagccacaggtttcctcttcttagagaaacctgatatgtaaaaaaaattcatcttgacaggaaaggtaaagcaggaagtaattattcatgttacaaaagaattaaccacaggatcttttaaatagcaagctcccttagtgcacggaagaatatgactcaatttgcaaaatgtgattgacacttgacattttagtagcacctttgttgggctgggaacggtctatcatcataaaatgcaagctgagtggtcagttgatcaagtctttattgagcacctactgcatgtcatggatgcttataggggccccagcagaactaagggtgatccatacccagaaggcattcaggggctcacagggaagacaagacacagcttgggattgcctcagtggcaggggccagagaggccttgggtctagaagagcttggaaggtgatgtggaggcagtcaggacctagctgtggccagaaggcaaggaggctgtgcatgattacttaagtttaaagaaagggcaatggccagggtggtcgctcacgcctgtaatcccagcactttgggaggccaaggcaggcagaacatttgaagtcagcctgaccaacacggtgaaatcctgtctctacaaacaatacaaaaattagctgggcatggtggtgtgcacctgtagtcccagctacttgggaggctgaggtgggaggaacacttgagcctgggagacagaggttgcagtgagctgagatggtgccactgcactccagcctgggcaacagagccagaccctgtctaaaaaaaaaaaaaaaattttgttttttttttttagtatcttcttaattatgtatagattgtgtacatatattcctgtactaattgaagatcaagaaaaccccagagaagctcctacgctgttattattaggcttaacaaacttttgaaacacataaaattgagtattgtatgactttagacattggtggaaaaatgaagacattttcttcatggttcaggtacatagttttaaaatatcttgctaatcctgatggttccacacttacaccaatgtcaggggtggaaagaaacccatattatgaatgatcttgataactgagtgtttgggggccatctccccgtaagatctgatgtgtcttccccatgtggtgggcaaagagctcccagcagaagctgaagtggcaactctatcattttctttctttctttttttccttttctttttttcttttttttttttttttttttgagacaaagtttcgctcttttccccaggctggagtacagcggcatgatcttggctcaccgcaacctccgccttccggtttcaagcgattctcctgcctcagcctccagagtagctgggattacaagcacccaccaccaagcccagctaatttttgtatttttagtagagacagggcttcatcatgttggctaggtaggtctcaaactcctgaccttgtgatccgccggccttggcctcccaaagtgctgggattacaggcatgagccaccgtgcccggccagctctcccattttcttggcacttggcctcgtgttgtctacagctcctactttctttacacagatcttttcaagcagctgacccactttgtgagggtgatttcagcaagaaggggtcatagccataaggaggctgtaccaggaggcaccagagaactgcagggcaccccatggtggggacacagtcaaaccatatcagatgggaattattagctttgacatacaactgagacctagagaagttagcatcacatggaatgctggtgcttgctctggtggtactccttgattccactgtccctctggctgcttcctgccccttaaaggatccctgactgtgtgtcctggagactgggtgaaggaacctgtgtcattctgtcaatggaacaatagagaagttgaattattacttttttaaagttaaaacaaaatgaatagacattgtaatttttttctcccatcatctcaatggatgcttaaaacctatctcagtgtattgaagttggtttgttgttgttgttgttgttgttgttgttgttgttgttgttttactcatttgtgctttttgtctcctatttaagaaatctttgccaaacctaaggtcattaagattttctcctatccattcttataaaaagttttacaattttagctcttacacttaggtctgtgaactattttgagttaattttagcatatgcatgctttacagagctcatttaacttttcctcttccattattttatcataatttctgaattgctaatttaccactggggatttatctaatttttgctatccttgtattcattcatttgccattcattcattcattcatacggatctgcaaataaaaaaggaaaaggtggctgggcacggtggctcatgcctgtaattccagcactttgggaagccgaggcgggcagatcatctgaggtcaggagttcaagaccagcctggccaacatggtgaaaccccgtctctactaaaaatacaaaaattagctgggtggggtggcatgcattcaaggagaatcgcttgaacgtgggaggtggaggttgcagtaagctgagattgcgccactgcagtccagcctgggtgacagagtgagactccatctcaaaaaaaaaaaaaaaaaaaaaaaagtgttatgaaattggttcatattgaggtggtcatgaggagaagtccagtctaaatgaattgcataagttaactaatttttggattggttaatgctgctaatttgcattggcactttgtcagtgagaagacccacctttcttacctgttgcctttgctcattaccaagtatgagagattttcatagatcaggaaaacaatgtaacatggaattgatgcgtaagagctcatctgttgagagggcagttgtggttctgatgtaggcggtctgagacattggcttggccagccaggccctctatgccacctgtctttacacgtgttgttgctgcaagatgggtgttacctctgtcggatggtgtattagtctgttcttgtgctgctaataaagacatacccaagattgggtaatttataaaggaaagaggtttaattgactcagttcagtatggctggggaggcctcaggaaacttaacaatcatgacagaagggaaagcaaacacatccttcttcacatggtggcaggaaggagaaatgccaaacaaaagggggaaaagtcccttataaaaccatcagatctcatgagaactcactcactatcacaagaaaagcatgagagtaactgccctcatagttcaattacctcccactgggtccctcctacaacacttggggattatgggaactacaattcaaggtgagatttgggtggggacacagccaaaccatatcagatggggattattagctttgacattttgtacaactgagacccagagaggttagcatcacatagtattggcgggggatgggagacccagaagtcaaaccgacatctgttgtctgtactctgagctcggggagacaatgctggacaccctctgggtggggcaaatgttgttatctggctgtcatcatgcagcttcccctctgaagcgcctgctggccccaagacctgtaggccaccctgcctgtgcctgaccacggaccagcactttgtggtttctgtgctataggcttcaggttaaccaaaattgggttactgtgtgtggccctgttattttgaatatttgtagaggggaagtccctttaatgttactttactggccttcaagggatactggacctcagccttctccaacatctgacctaaattactctgttttccctgttccttccagtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagtgagtacaaagcaaaacccttttcctgtctcctgtgtgggctctgctgaccaaagtctatgggggcgcttgaggatgaattgcatgaactctcttagggaatggcttgccctcctctgtgatatcaagagaagcatgtatagttttgcccttggtatctgggatacttgttttgaaattgcttttttgaggctcaggatgatctctttccactgtgtatcacttcttaggatatgctaaggctgggtgcagtggctcatgcctgtaaatcccagcattctgggagactgaggtgggcggatcacttgaggtcggaagtttgagaccagcctggccaatatggtgaaaccccatctctactaaaaaaaaaatacaaaaattagccaggtgtggtggcatgtgcctgtagtcccagctactcgggaggctgaggcaggagaatcgtttgaacttgggaggcagaggttgcagtgagctgagattgcgccactgcactccagcctgggcaagagagcgagactgtctcaaaaaaaaaaaaaaaatagtaaaggctgttaaattgttgtatgtacttgtttatttgctttggaagtttaaaagaattttatttttttctattccttgcaaaatggaggtaaaactcagttttgaccacttaaataacaattaaattaaatgtagaattcagccagacatggtggctcatgcctataatcccagcactttgggaggttgaggcaggagagtcacttgagcccaggagtttgagaccagcctgggcaatatagggagatccctgtctctacaaaaataaaataaaataattagccaggcatggtggtgtgcacctgtattctcagctacttgggaggctgtggtgggaagatcacttgagcccaggaggttgagactgcaatgagccgtgatcatgccagagcactccctgtctctaaataaataaacaaacaaataagtaaaggtagaatccaaattatggaatgctttgaacgaatgaatgaatatagaattcaaattatgcaatgttttccacctttgtattcatattgcctttttttttttttttttgagacagtcttgctctgttgcccaggttggagtgcagtggcatgatcttgttctcagctcactgcaacctccacctcccaggttcaaatgattctcatgcctcagcctcccgagtagctgggattacaggcatgtgccaccacgcccgactaatttttgtatttttttttaagtagagatggggtttcaccatattggccaggctggtctcaaactcctgacctcaagtgatccgcccacctcagcctcccaaagtgctgggattacaggtgtgagccaccatgcccagctcatattgcctttttgataggagcaatattattttcctttacccctttatgtccatgaagcattaaacaagacttacttcttcagtaatgttttgaaaattatgccttttggagaagtcatctacaggttaattataaaaatgtaactcattcatattaataaattaccacacagttgtaagtagtactttgaattgttgggtagaaaaagatcacctggaggctattcctcatgggaaatattaactaggtctagaagtccccttgccataaactttctatctcatactggagaagaatggattgttctcagaagaatgggttgtcctcagtgggaagacctgcatgcagaagtccccaggtcccctgctgtagtctccgtgttaccagataatacttaagaggactgtgccttggatacagggaggcaggtagtatggggaaccttgggcccagagaagcaggtgacccccgccaaaggagccctgagggctgggtgggaggggttttttatgacaaggagttgttgatgaaaaatgtgtgatggacactggacttccagtcactaccctttcagagtcgaaaatgaataggaacctatttaaatctttctttaggatcttgtctcagggtgatcctgctagcatttctgttttcttttctctttggtgtgagaaggctggggagagttttgtagggaacatgctgctaaacattgctttctggagttgtaggaatataggctttccccccactgtactacacttgaatccagccgctcgctcccattttaagagtgggaaagtgctgcatctgggccaccacagactctgttgaggtgtgaatgggagttcttttgcatatcccaacaaagaccccagttttaggaaaggagcatccctgaagttgagctgcattctagtgtggaaagagggtttttccagataaaaggggcagtggttagagtgaagatgaaggaagaaggaatgacagaaggggactgtgggaaagagagaagaccctgggaaggagggaagactgtggggaaggatagcaagattgtgggaaagtgagcaggactgtggggaagagagaggagggccctgggaaggaaggaggactgtggaaaggcgaggtggatggtgggaaagagggaggaggaccctaggaaggaggactgtgggaaggggagaaggatcatgggaaagagagaggaggaccctgggaaggaaggagtactttgggaaggtgaggaggactgtgggaaagagggaggaggaccctgggaaggaaggaggactgtgggaaggggcggaagactgtgggaaagacagaggaggaccctgggaaggaaggaggactgtgggaaggggagaaagaccatgggaaagaggtagggggaccctgggaaggaaggaagaatgtgggaaggcaaggaggactgtgggaaggggagaaagaccatgggaaagaggtagggggaccctgggaaggaaggaagaatgtgggaaggcaagaaggactgtgggaaagagggaggagggccctgggaaggagggaggactgtgggaaggagaggaggaccgtgggaaggagaggaggaccatgggaaagagagaggaggagcctgggaaggagaagggactgcagcatcagctccagttttgagggtaggtcgtattttgaacacctttaatgtgtcttgttggcctagtgtcacctgattttaaaccacaaatctacagattcagagaactgagttggaaggcactgagaaagcctatggaatttgctcatagcatagggctggcgcgctgtcagtgactgtggagggaaccagggcagggaaatgcagtgtaggaactgcccacgcgagagctggaacctgaccctccccctgctcggagaggactccttgctgtgaaatggaggtgatgtcttgaccagaaggtctccgcattgccccacctgctctgctttgggctaggccagtgtgggcatggcagcaggctcctgtcctgtggcttcccatgggctttggctcaagggaagccctggtgggagatggcagggagggatgcgagtgagattggggggcggggggaggcggttatcccaccaactccctgctcatgtggattttgggctggccgtgtctctcatgggatgggtggctgctccagtcaggctcaccttcctccttacccctctctcctcattccttcaggtctgggggcttccttgtttcgagtccctggctaccaccttgggctttctttatacctcacccaccctgtgaaagagtattaatcccacttgagattaccctaattcgagtgggccatctgtttccttttgagaacccgactacctcatcggcctgttcagaggattaaaccagagaatgctggaaattgtttagcacagtggccagcccctcagtgagtgtgccacagtgctggtcactgggtgagggaatgggtcctctcctctgggcctgaattgccctgcgctcacctgctcaggtgtcctctagtttcagccggagcacttccagggaggggaagacatgctcttgagagatgcttgctctacctagggcagaaaggatgtagcaggagtggctggggctgcgctacttgtagctgtcacatttggcagaaaaagaaacttctattctttcagatggctgagtctattttcaagtcttcacccactggaaatgttttaggcctattattgaaaattcagtaggtggttgcagtggagttaaacaataaccaggactctgtagagaattctaaaagctgaaaatgcatctttaagtaatagtaatcatattggcataggtgtgcacttttgaaagtggctttatgcatgtcctatgtagtgtaagaataatgtgtccccagatggaattgggtagttttgtggaatgtctttctttttttttttttgggatggagttttacccttgttgttgaggctggagtgcaatggtgtgatctcggctcaccgcaacctccacctcctgggttcaagtgattttcctgcctcagcctcccgagtagctgtgattacaggcatgtgccaccacgcctggctgattttgtatttttagtagagacggggtttctccatgttggtcaggctggtctcgaactccctacctcaggtgatccgtctgcctcggcctcccaaagtgctgggattacaggtgtgagccaccacacccggtcaggaatcccatttttatacccacatgcctttctgtccatgttaccactgtcagagagcctaccttaagcattttcttttctttttttttttttttttgagatgggttgcactctgttgcccaggctggagtgcagtggcatgttcacagcttactgtagtgtcgatctaggctcaagtgatcctcccacctcagcctcctgactagctgggactataggtgcacaccaccacacatggctaatttttgtatttttagtggagatggggttttgctatattgcccaggctggtcttgaacttctggcctcaagtgatcctcccgcctcggcctcccagaatactgggattacaggcgtgagccaccatgccctgccaaacattttcttgattcatttagcagatccttattcagtatcccatttgagcgtggtcctccagagtgttgggattcgtatccaccttcatctcagtgctgtctcagtctctcaagagaaaaataccagccattcccctggtatactgagtagcaggccatcccattgttaagaagatacctgtgctttgtcagctcttgggctatttttcattatgcagaaatgtacccagctaggccacatgcctttttaggtttgtctctcttttatttagtttgtccttatttatttattgtaaatatggaagaagaatcttttaaaatctcccttctctttcttttctttctctctctccccacccatgtctttttttgagacagggtctcattctgtcacgtaggctggagtgcagtggcgtgatcacggcttactgtagcctcaaactcctgggctcaagcaattctcccacctcagcctcctgagtagttgagaccacaggtgtgagccaccacacctggctaattaaaaaaaaaaaaattatgtagagacagggtctcactatgttgcctaggctggtcttgaactcctgggctcaagcagtcctctcactttggcctcctaaagtgttgggattataggcatgagccactatgcctggcccccacccacttattttggaatacatttttctttatccctcccctttacaaaagtattcatttttaaggtgaaatttatgtagagtaaaatgcataagtcatatgtctatggcttgatgatttttttttttttgtttctacgtaagtgcgtacctctataaccaccacccagatcaatgctatttctatccctctagaaagttccagcatgcctataaaaaggaagggggaaatgtcagagtcgttggaaccagagcaactgcatcttgaataggggttaggtaaaataaggctgagacctactgggctgcattcctagacagttaggcattctaagtcacaggacgagataggaggtcagcacgagatacagatcataaagaccttgctgataaaacaggttgcagtaaagaagccggctaaaacccaccaaaaacaagatggtgatgagagtgacctctggtcatcctcactgctacactcccaacggtgccatgacagttgacagatgccatggtaatgacaggaagttaccctatactgtctaaaaaggggaggaactcgcagttccgggaattgcccacccctttcttggaaagctcatgaataatccaccccttgtttggcatataatccagaaataaccataaaaatgggcaaccagcagctccaggcagctctcggggctgctctgcctgtggagtagccattcttttattcctttactttcttcttcttcttttttttttttttttgagacggagtgcagtggggagatctcggctcactacgacctctgcctcccgggttcaagggattctcttgcttcagcctcccgagtagctgggactacaggtgcgtgccaccatgcccagctaatttttgtatttttagtagagacagggtttcacatgttggccaggacgatctcaatctcttgaccttgtgatccgcctgcctcggcctcccaaattgctgggattacaggcatgagccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgtataaatggagtcatacaatatatgttcttttatatatgactggtgcacaacaaaatgtttttgcgtacatcggtactttgttcttgctgtgtagtatcccattatgatgaatatcccataatttgtttaatattttgttgatggatatttgggttgtttccagtttgaggattttattgatagaggctctgaacattcttgtatgttgtcttatggacattagcactaattgctcttgcatatgcacacatgtaagagtggaattgctgctgtcactgactttcaacctgtagatttttctctgtgtaaagttgtggcttccattgggtgaggggaggaggtgccatacctgtgcctgaagcctcatttgcgccacactagtcaatttagctaatcagcctgaatcttgtcataatgtagccacctatgaatataactggtgaggcgtcctgatgcacagaacccaatctcccagtgatgatttgattattgggccccaggaactgacaaagactgatttttaatttatttttttattttttttagacagtcttgctctgccacccaggctggagtgcaggggtgggatcatagctcactgtagcttcaaactcctgggctcaagtgatcctcttgccacagcctcccaagtagctaggaccacaggtatatgccacctcacctgggtaattattttgtattttttgtatagacggggtttcaccatattgcccaggctggtctccaactcctgcgctcaagtgatccgcccgcctcagcctcccaaagtgctgggattacaggcgtgggccaccgtgcctgggcgggtcttgctatgttgttcagctggtcttgaactcctgggctcaagtgatcctcccgccttggcctgcccaagtgttgggattacaagtatgagccactatgccaggcctattatattgttaaaaacatacaaagaacatgtgtcaaagtttcgttgaacttatttaatgagggaactagcagaataacaaaacaagctcagtgaggatatgaggaactcagtggaaaaaaaaaaaacctcagtggaaaaaggaatgttcaaataagattgctaagttaggttcaaaactggttcatgtcttagagaacaataaaatctttacctttggggttatcatctctaccagaaaagaaaaaagagaaaacagcataccttatcatttttctacattatcttctgacttttataggattgtaaaatatcctagtagtgttagttaaatcaagttacattttcagagtcaggtgaccctcctggcgggggatgggggggagtgtttattaaaaatgcaatagcatgacattaaaaggtcacatgatcatcttttttgcctagtttctaagttttgggttttttgtttgtttgtttgtttgtttgtttgtttgtttttttgtttaacagaccatgacagaccataatatggggtacaataataggaaaaactaggatgatatcttaaagtcatttaatgaaaaaaaaaaaaaaaaaaaaaaaaaagactgcacttctgggacctcagactgctacctaaaacagaaagccagtcacctatttcaggtagatgtggactctttcacaggggttaattttcccatgttggatttaactaccagtatcttccttttaaaaccttaccctcagatccagacaacattgttctttagtcaagcaaagcatgtataagcagccttttcttctgagttctcctggaagggacccacagctattcattttcaaatgaattttaaaagaaaaaaagccttgaaactatagctcgggctgatgtgcatgtgtctgcctgctcttttaggggacatttgtctgttaggggacatttgataaagttcaacaggacacaggccctcaacattttgtagctcacagatagacatgtggaaggcaggaagctatgataggggttaaaagaatatgcttgttgatctttaaatttatctgactctgtctgtgaggaagtaagctgttttctctgcctgtttttgtatgtgttcggcaaaagtacattttcccctctgcctgcccaattgttgatgggtgaagtgtgtacacttgcagcttgcatgtcctatgtgtgctgagcataaccattctcagctcacttgccgtggcctcagctttcatttgctaggtgttttagatctctctttggcacatttagagcccattttgatatttgtttaaagtggttggtgaatgtggctgttcttttttgatccatgaggcgaaaggccagtattttgcctaattgtaccactccaagataaagctcacagttactttgttcttcttgatttatgaagggatcacaaatctacttcaacaagtgtcataaagtagagattttcaggttactgttctacattcaaagaccctgacatggacctctttaatcatatttcacttttctttaaactttaaactcaagggccattaattttgtgaattatatggatgattgttttcaagatgtttgtctctcttcacaaggtagcagtaatttttctgggtgtgttatgttatgttatgttatgttatgttatgttatgttatgttatgttatgttatgttatgttatttagagacagtgtctccttccatagcctaggctggagtgtagtggtatgatcatggctcactgcagcctcaacctcccaggctcaggtgattctaccacctcagcctcccgagtaactgggactatacacatgtaaccacctaacctgttttttttttttaaattttttgtagagatgggggtatcactatgttgcccacgctggttgccctcctgggctcaagtgatcctttcgctttggcctcccaaaatgccagggttataggcaggagccaccgtgccctgtccaggtatgtattataatgtgcagagcctcatcttgctcacaacatttagtcctggtgtccttgggcatgtgggcatctgctgtgtgttaggcaccagaggatataaactcaaatgagatggactgaatggaatattgtcacaaatgtaacttctagaggatgatagttttagctcctatgacctgcctttgggaattctgtgctttaaacattgttctacaaagatattctgtaaagatgttctggattaaaatgccacttgagaagtttctggctgaattcatccagcaactgttagaatgtgctaaatgaacctacagttagctttttggccctgatggctgtgttactttatggagtaataatggctgcattctattcaaggcttactggctgcctggcattgtatgtataatctacccatgtctgtctgtgtacagtgactaaaatttgttgagcccttactgtatgccaggtaggaaggaggccaagccctttccatgtttttttgtttgtttgttttttgagattgagtctcactctgtcacccaggctggaatgcagtggtgcaatctgggctcattgcaacctccacctcccaggttcaaacagctctcgtgcctcagcctctggagtagctgggattacaggcgtgcaccaccacgcctggctgatatttgtatttttagtagagatagggttttgccatcttggccagtctggtctcaaattcctggtctcaagcaatccacctgcctcagcctcccaaagtgccgggactacaggcatgaaccaccgtgcccagcccctttccatgcttttttatctcatcaaattcttctaccactctatgacaggtaactgaggcatatcagtgttaaaagccatactcacagtcacacaaactagtgaggagcaaagagagcattagaatctaggccaaccagctctgcaacctgagctcaagcgggcagcattatctgggtgtctgaattgtcctgacaggactgtgctcctcaccattattgtctgctgtattatgccttccccaagtgtccattcaggtggaatcatggtatttaacttatttctgtctgcattttaaataattctcttcaaaagttggccctttcaactcaaaagaacaacctttgcctggatttatgggcttgtgttgttttttcctacaaattctgaaattaaggcaattagggaaaatatttcgttattattaatttgtaagcacacgttgttttgcagtgttcagcaggctatgctttctaggagtttgactgtcttttctatcagtggtaaataatcaagatgtgtgactatccaattgttccccatccacggggccctcaaaaccaaccaattccagctcaaattattcttgaaactttaaacatacagttttctttcagaaaaacaatttctaaaactaacaactggaacctgttagattctgttgtgagaaatgttattccaagtagggtctggagtaattaagtacaagtgtgttaccaataagaacccacatcatttggtggtttcttcaggctttgtaactgttgtagtgcagaaaatgtggtggaggggggcggtcttgtgactcagggagagctgtgacctcagtgagttttaatcgcctgactgagttgatcgtggtgattatgcataatggaatcttattttcttaatggcaagattatcgaatcttagcttggaaagggactttaagatcatgtgttttaacccttagctttctaccagatcaaaatctaaaccatctgagatatcaccgtgatcattactggatatttaaacttgttaagcttggggctcccacagcgactccatgtcagtgtgtctctaacctggtcctgctccaggtgcactacgtcatcagaattttgttttgggggcaggagtagggatagaagccttagaatcttttaaaaagttcaggtgattctgctgcttgatctaaagcttgggcattcattttgcacaatggtaccgatagggcagtaccatgtttttaattctagtttcttttctcaagaacatgaattggtagctggtgacttcaattagaaaatattttcatcttatttctaaagtagctttatggataaagtattaatagctatattagtgaatatgtaagtaaacacaatcatgctggaaattattgtaaaagtttactacaaatacacaaagaacatagtgctatgtaaacagtgcttgatttaagtccattagaattaatacattctggctgggtgtggtggctaacacctgtaatcccaggactttgggaggccaaggcgggcgaatcacttgaggtcagaagttcgagaccagactggccaacatgatgaaacctgtctctactaaaaatacaaaaagtagccaggcgtggtggtccatgcctgtagtcccagctactcagaggctgaggcacaaaaatcgcttgaacctgggaggcagaggttgcagtgagccgagattgtggcactgcactccagcctgggcaacagagtgagactatctcaaaaaacaaaaaaaaccaaagagaattaatacattctaattgcggaacttctgtactcagtgattctccatcccactctatacctggtggtagtgagataggcacaatttctagcaatggtcctcaagattctactcttaagtccccacaacttctacatgtgatgagctatcactccagtgattttgttatgttatatggcacaattgatctttaaacagggaggtgatccaggtgggcctaacatgagtccttaagagcagagaactttctcctgtctagtggcagaagagaaagtcagaggaggacttgctgctttgaagagggaggggtcatgtaagaaggaaatgggcagcctataggagcagagagtagaccttggctggcagccaggaaagaaatggagacctcagacctacggccgcaaggtgctggattgtgccaacaacctgagtgaatttggaagtgggttattcttccaagccgccagataaaagtctagcctattcacatcttgatattggcctgtgagaccttgagtgaacaaagaatccagttgagcctatcgggacttttgacctacagaactgtgagataaaaaatgggtgtcgttttagataacccatggcagcattccctcctctgctggaatgtcgtcagtggagactgactggggattctggacttccatccccatcctcccactcagcagtggtaggcagctccccctccccactagagaatggggaaaatcttggagaggagggagctgaagaaaggaattaattaaaggaatattccctgcctgcattggaagtcctgggcaaacaactcctaacccacctgcatgtgaatctgactagaacaaacatgccaaaaagtttagcaatagaaactttaacacagaatatcacccaggttttcagaatgacctctaagtaacagagatgaagcagaccagaatagtactgcaagggctctgaaatcaaactatcgttaaaactgcagccaacgaaaatagcccaggatgtgcgtacttagcctcaatagggttaatgccagctaaaatttaaatagtatctagagtcttgtaagataataacccaagtgcccaaggtacaatttaaacaatcacttgtcataccaagaaccaggaaaatcacaactcgaatgagaaaagccaatcaacagatattaatactgagaagactcagatgttggaattatctgacaaaggttttaaagcatctgtcataaaattgccttaataagcaattccaaacactcttgaaacaaatgaaaaattagaaaatctcagcaaatcaataggttttttaaaaatggaagttattgaaccaaaaaataaacaagttaaaaagctcaccagatgagctcaataatagatgacagaggaaagaatcagtgaacttgaaaatagatcaatgaaacttacttagtctgaacaacagatagaaaatagtctgtaaaaaatgaacagagccttagaggcctatgggataataacatcagatctaacatttgggtcatcagaattccagaaggagaaaagaaggttatgataataaacaatattgaacgaaatgatgactgaaaactcaccacatttggcaaaaagcataaatcttcagaattcagaagctgagcaaaacctaaacaggataaacctagagaaatctatgccaagatacatactaatcaagcttctaaaaatgaaaggcaaagaaaatgcagcaagagagacatgacatatacttacaaggaagaatgatttgaatgacaatgaatttctcctgtaaaataatggagtccagaaggaagtgtacaacattttcatgggctgaaagaaaagaaagattaactctgaattctttgtctggtgaaaatatccttaaggaatgaagagaaaatgaaaacattctcagatgaaggaacactaagagaatttatcaatagcagacctatccttaaataatgcctaaagaaagttttttaggctgggcacggtggctcacgccggtaatcccagcactttgggaggttgagatgggcggatcacaaggtcaggagatggagaccatcctggctaacacggtgaaaccccatctctactaaaaatacaaaaaaattagccaggcatagtggcggccgcctgtagtcccagctactcgggaggctgaggcaggagaatggcgtgaacctgggagggggagcttgcagtgatccgagatcatgccactgcactccagcctgggcgacagagtgagactccatctcagaaaaaaaaaagttttttaaacataaaagaaatggtaacagaagaaactttggaatttcagaaaggagaaaatagcaaatgggtaaaaatagggagtatgtatagtaggccaagtatagggtatgtgtcattaatttttttctgttgttgttgttgagacggaatcttgctctgttgtccaggctggagtgtagtggcacattcttggctcactgcaatctctgcctctcaggttcaagtgattatcttgcctcagtctcctgagtagctgggattacagatgtgcaccaccatgcctggctaatttttgtatttttagtagagacggggtttcaccatgatggccaggctggtgtcaaactcctggcatcaggtaatccacccgccttggcctcccaaagtgctgggattacaggtgtgagccactgtgcccggcttgtatcattaatttttaaaaacatgtttgatggttgaagcaaaaattagatcatctggtgtggtatccaatatatattgaggtaatatgcaagaaaattatatttaagaggtggggaggatgtaaaagaacctaactggaagtaaggtttttacacttcactgaaataggaaaatgttgatcgaagtagtctgtgacaagttacatatgtatattgtaataactaaaatactctaaaaatcactaaaagtataactgtacaaagagatatactaaaactgcctatatataaaaggaaattctaaagaatgtacaagtaacccacaggaagacaagaaaaaggaaacaatgaaaaacagagtgaacaaacagaaaacaaataatacaatggcaggtgtaagtcctaacatgtcaatatgtgttttaaatataccaattaaaaaacagagatgatagataaaaaaaaaaacttgactcaactatatgctgtttgtaagaaactcacttcaaatatattgatataggcacgttggaagtaaaagttggaaaatacatactatgcaagtattaattttaaaaaagcaggagtggctacatataatatcagatagggtagaccagagagcaaagaaaattaccagggacaaagaaggacattacacaatgataaaagtgtcattccaccaagaagacgtagcagtcctaaatgtgtatgggccaagcaacagagctgcaacatatatggagcaaaaactgatagaactagaaaatagacaagtacacagttatagttggcaacttagcatctctttctcagcacttgacagaattactaaacagaaaatcagcaagggtatagaaggcctgaacaacataatcaaccaagaagttgtaattgatgtttacagaatatcctacacagaaacagcacaaaacacatttttttcaagtacccatgaaatatctgccaagttaaaccatatcctgggtcataaaactaacctcaatatatttaagggaattgagataataaaaaaggtgttctttgaccataagtaattaagctagaagtcagtaatggaaagatcagaaaatctccaaacacttggaaatcaaatcacacacttctaaataatccacaggtcaaagaagaagtctcaaaaagattaaacaaacacatagaactgaatgaaaatgaacatacaacatattaaaatgtgtgggacccagctaaagcagtactgagaggaaaatttatagcactaaagtttacattagaatggaggaatgttctcagatcaataatctaaggtcctacctcaagaaactagaaaaagtgaaataaaccgaaaacaaccagaagaaggaaataatgaagataagagcagtaatcattgaaggtgaaaacagaaaaacaacagagaatatcaatgaaaaagccagttctttaaagaccaataggctgggtacagtggctcatgtttgaaatcccagcattttgggaagcgggagtgggaggatcacttgagcccaggactttgagaccagcctgggcagcatagcaagacactatctcgccaatcaaaaaataataataataatcaaaaaattagctggacgtggtggtgcatgcctgtggtcccagctactcaaaaggctgaggtgggaggattacttaagcctgggaggttgaggctgcagtgagctgtgattgtgccactgcactccagcctgggtgacagaatatgatcctatttcaaaataaataaataaaaagatcaataaaatgggtaaacctctaagaagacaggcaaagatgaaaaagacacaaattagcatagtaggaataaaacaggtgatatcattacagattctgcagctattaaagggacaataagcgaatactaaattatatgtacatacatttgacaacttagatgaaatgaaccaattccctgaaaactacaaactaccaaaacttacccaaagtgaaataatgtcaatagtcctataactaactgttaaagaaattgaatttgtcatgtaaaagcttccaaaaaagaaatctccaggcctagaggtttttcgtcataatttccaccaaacatttaaagaattagcaccaattctgcataatcttttcgagaaaatagaagaggagggaatgtgtcccaattcattttatgaggccagtattaccttaataccaaaaccagatagtgcaacaaagaaaactgcaggccagtgtccctcaagaacatagacacaaaagtcctcagcaaagtattagcaaaacaatccagcaacttataaaaaaaattatatactatgaccaagtggggtttattccagatgtgcaaggccacttcagtgtttggaaatcaatcagtgtaatccatgatatcaacacgctatgggagaaaaaatcaaatcgcataatcagatcaattgatgaaaaaaattgacaaaattcaacgccattcatgataaaaactctcagcaaactaggaatagagaggaattcccccaacttgataaagagcatctacaaaaatgctgcagttagcaccatatttaatggtgaaagactgtatactctccccctgagaatggggaaataaggtaagaatgtctgctcttaccagtctcattcaacgtaatactggaagtcctagctagagcaactagttgagaaaaaaataaaagacatatgaattggaaaggaagaataacatcttatttgcagatgacgtgattctccagtagaacatcccaagaatttaccaagtaactcctagaataagtgagtgcagtaaggtcacaggatataagatcaaacacacaatttaatatttctagatactagcaatgaacatatggaaactgaaattaaaaacacaatgccatgtacagtctctcccaaaagaattgaaatacagttatgcattgctgaacaacagggatatgttctcagaaatgcattgtaaggtgattttgttgttgtgtgaacatcatagagtagtatacttatacaaacgtaggtgatatagcctactacacacctagccatattgtatggcctatcactcctaggctacaaacctgcacagcatgttactgtaggcagttacgacacaatggtaagtagttgcatatctaaacatatctaaatattggctgggcactgtggctcacacctgtaatcccagcattttgggaggccaaggtgggtggatcacttgaggtgaggagttcgagaccagcctggccaacatggtgaaaccctgtctctactaaaaatacaaaaatgagctgggcatggttgcctgtgcctgtaatcccagcaactcaggaggctgaggcacgataatcgcttgaacctgggagacggaggttgcagtgagctgagatctcaccactgtactccagcctgggcaacagagcaatactgtctcaaaaaaacaaaaacaaaaccatatataaatataaaaaatgtacttaatacaatagaagtatggtattataatcttatggggaccattgacgtatatgttgtctattattgacaaaaacaatgttatgtagcatatgactatacttaggtataaacttaacatgtacaggatgtgcatgctgaaaacaacaaaatgttgttaatagtattcaaagaagatctaaataaatggagagacataccatattcatggactggagtcagtgtggttaagatgttgattcccccaaattaacctgtagatctaatgcaatttctatcaaaattccagcaagatttttttttgtagctatagactagtttattttaagatttataaaagaaatcaggagaactacaatagtcaaaacattttgaaaacaattttgaaaaagaagagcaaaataggaatctacccaattttatgagttaactttaatagttatagtaatcaagacagtctagtattgacacaggaatacacatatagataaaggaacggactagagaacccagaaataaacctacacaaatatgcccaagtgactttttgacaaaagggcaaaagcaattcaatggaggaaggatagccttttcaacaaatgatactggagtatttggacatccatagacaaaaaaagtgaaactcggcctaaatctaacatcttattaaaaaattaactcaaaacggatcatggatttaaatgtaaaacataaaactataaaagtgttagaattaaacataggcaaacattttggggacctaggcctaggtgaagagttcttagatatcataccaaaaacaaaatcttttttgtttttgctccgttgcccaggctagagtgcagtggcacagtctcagctcactgcagcctcgacctcccaggctcaagtgctccttgtgcctcagcctcccaagtagctggaactacaggtgtgagccaccacgcctggctaattttttgtattttttgtagagatggagtctccctatgttgcccaggctggtctcaaactcctagactcaagtaatccactgccttggcctcccaaagtactgggattacaagtgtgagccaccacacctggccaacacaatctattaaataaaaaaagatcaattagacttcatcaaaatgtgaagaggatgaaaagataggttacagactgggaggaaatatttgcaaaccacatgtctgacaaaggacttgtatctagaatgtgtagagctctcaaaatgcaacagtaagaaaccaaaacaatctaatgaaaatgggtgaaatacacgaacagacattcactgaagagagtatgcagatgtaaaataagcacatgaaaagatgtccaacatcattagtcattagaggaatgcaaattaaaaccacaacaagaaattactatgtatctattagaatggccattaggatggctaaattaaaaatggtgataacaccaaatgctggcaaggttgcagagaaactggttctctcatatattgatggtgggaatgaaaagtggttcagtcagtttggaaaatagtttggcagtttgttatagaactatgtgcttcccataggatgcagcagttatacttttggacactcatcccagagaaataaaaacttaagttcacagaaaaacctgtacacagatgttcatagcagctttatttgtaataattgcaaattggaaatatcttgaattgtctttgagtggatgaatggttaaacaagttccggtccaaccataccatggaatactactcagcaataaaacagaatgaactcggatacacacaacaacttagatagatctcaggggcatcgtgctgtgtgaacaaagccaacctaagatgttacacactgtatgatttcatttatattacattctcaaaatgacaaagctatagacttggagagcagattactggatgccaagggacaatgacagggtgtggggaagactggtaccacaataaaggggtagcatgagggagttccttttgaagatggaatagttctgtatcttgactgtatattgattgtgatccagtgtgtagatttgtgcaaatctacacattggatcaagttgcaaagagttacacacaaatcagtgtatggaatgactgatgaaaacggaataaggtctgtagtgaacagtattgtaccaatgtcaatttttttgttttgatattgtactatagtcatatatcatcactgagggaagctaagtgaagggtttatgggactccatgcaccgtttttgtaagttcttgtgagtagataattacttcaaaataaaaattaaaaaaaatctccaatgggtctcaaccttggcagcacacaagtatcgcccaaggagctttaaaaatcccgatgcccaggctgcatcttagtctcatctttatctctgattgtgagtctcagcattagtattttttaggatttctaactcttgtccttgttgttttccattaaattaaaaaaataataaccaccaccaggaccataccactttcccatacactgcagttctccagctctttgtgggtgatgggtgatgggtgacagattacaggtgtttcagttctttctcaggaggtcagactctgtcatcctgttgtcatgtctgaggctgggatttggggaagccccacccccagctttgagcaggtccaaggaggcattatcacttggcctgtctgtggttggcctggagactggagggccaatgacagaagtagagttgggaggagaaaagaaggatggaggaagagagaagtgggggtggagtgtgagaggatgtgggcctcagagaccctgttgagcctcaccctgggcctagtctcttggagcaagcatgtttgaggaggagaaagaaggggaggggaagatgaatgttggggatgggattgcaatttatgatagggaggccaggaaaggcctcatgaaaaaggtgatttaagtcaagacttgaggatgtgaggaagaactttgtggggatctgggggaaagagcccttcgggcagtgggaacggcacgtgcaaaggccctatggaggagggtgtccctggcttgttggaggaacaacagagagaccagtgcaccaccactgccggagggaagagggcaggggagagcaataggagaaggggttagaggacataggttacagggctccagatcagggagggccttgtgacttgtgactctgagtgagatgggaagtaactggggaggctgatgcgaccagagatgttttaacaggttccctctggctgccgtgttgagaaaagactgcaagggggaagggtggaagcgaggagagcagtttggaggccctttgcaggaatacaggggagaccagggggtggcagtgggagggtgagaagtggtcagattctggatatttctgtaagtacagccaacgggatttgctggtaagactgggggtgtggcaggagaggaaggagggagagatgactctaaggtttttgtcctgtgcattgggaagcatggtagggatgtgggtctggagtgtgggggccaggtccaggctagagataggaatttgcacagctgcccggctgtcagcccaggcccaccacagaaccacctctggcactacaattcctgtttgatgcaaggatggctgcttttcttacctgtcaccctgtgatgtgaaatcatgcatttagagcaacttggtaaatattaatttgtcaacaaatattagctattaatatcagtattaagccactccaagacactggagaaatacttagatggtgtttagcagtttggtactgtaggattcggatgctgagatggagttaggagtagaggaggtttgtttgggggctggggggataacacccttgaaggatgagagagcagaggagcagggcagggagagcctcaggtggtgatgccagtctgtcctggccagcctaacagggggcttctggacaaaaattgctccatgaaagcaaaggggagatgctagccaaagggcacaaacttgcaattacaagacgagttctggagacctgctgtgcagcacggtaactagagttaataatcatgcattacatacttaaaatttgagagtaactcttgcgtgttcttattacaaaaagggaactctgtgaggtgatgagtctcttaattagcttgattgtgatcgtcatttcacggtgtatatatatgtcagatcatcatgttgtacaccttatattaatacaatttttctttgtcaatcatacctcagtaaggctggaaaaaaaaaaaaagaaatgggcagaaatggccaggctctaggactgcactccccagattagtgaccagctgttggctcctcagcgagagcatggcctctgctagaaagaaagctgaggcagattccaaaggtgcaagttagttctttccttcttcttcttcttcttcttcttcttctttttttttgtttgtttttggagacagggtctcactctgttgcccaggctggagtgcagtggcgcgatcatggctcactgcagcctcgacctccaaggctcaagtgatcctcccacctcagcctcctgagtagttgggactacaggcgcgtaccaccacatctagctaattttttgttgttgtcttttgagacagagtctctctctttcacccaggctggagtgcagtggtgcgattttggctcacagcaacctccgcctcccgggctcaagcgattctccttcctcagcctcctgagtatctgggactacaggcgtgcactaacacacctggctaatttttgtattgtttgtagagacaaggtttcaccatgttgcccaagctggtcttgaattcctgagctcaggtgatccgcccaccttgtcttcccaatgtgctgggattacaggtatgagccaccatgcccagccccagctattttttttttttttttttttgtagagacggggtctcactatgttgcccaggctggtctcaaactcctgggctcaagcaatcctcctgcctcagcctcccaatgtgctgggattacaggtgtgagccactatgctggccaagttctttcttgaaggaacatatgggcagtacatctttagggctacccagaagacattttgtttcactttagcttcttaactcacaaagggatatgaaatagtatattgccccactcgcaggctaaggggtaaatttcatcatctttatgccactgagggagatgagataaattcttgaggagagttcagggagagtgaaggtgaagatgtgaaagtctctttaatgtgtagtcacaacatgtactagcacaaaagtcacacaaacacacagttatttgtggaatgaggtgtatgaagtcagcccgtttttgctcttagctgtctattttgctcgtcatgaaggagagcttttcattattgtcatacttcctctgggaccaccaggattttctcatgaagactaacaaagagatgatatcatgtgtctgggagtcagggtgaaaaacaaagtgggcttgcctgagtttgtaagctgagaagttgtccgagtcaaaccacatcctgccctgggtttctagaggcaggtggtcccagatggagacccagagcgggaggaactgtgccaatgctttcctaagagccatgctcagttcccaggaggtgtgggggaggccctggtgactatgtcctctttacactgaagttttcttctagggaggccacaactcactggttgccagtaaaggttgtgaagttggttccagttccagttgtggctgtgctgtgaaccagctgtgccactggtggccatgctgaagctcttggggttgtacttttcctggctgtcaaacgaagccatggtcaaggtctgagatagctagtgcaggtaggtagtatcggcgcagtgggggccaagtcaaaaccaaagagggactgtttttgcgtatcatggaagaaaaagtaaattaacattaaaaccatgtttaaaatatttattagatgtacattttagttgtgattatactacaacataattggaattgatgaagtattaacatgtgaacatattcttagcaaagctggacatgtttggagagtaccttgtcaagagtgtgatgcctgctgccgaaggcttcggtccagtgggatttgctttctgaccagataagattttatctaagagacaacatccaaaatcaataggctgacagattattggtaaaagatacattacagctgtttaaaaccataaacgctatcaagttctaactgctaagcctgtagtcatattgtaatatcgggaccctcatgggcacagatatgaaaggaatcaggatggtagctgtcgttctgtaattgctgtttaacagcctggcttatattcatgattcaatctttttttgtttttttcttgcttccacaattcaatccttatttctgtaagctgcaaaatcgtgagtgtgcgcacaagtttttttctcccccggtcttgaaactggaataattgccaatctgcttattaaaaaaatacatctgccctatgaaagtagtttcagctactctgtgttaaatgagtgattatgacattgggctctggtggcacgtaatactaatgctgaaacgcttgaatatggaggttagtgtggtttcagatgttgagaaatcacttctttgtgcttattgacatttttccaaggactgctctgttatttggcttaaaatgtcacatgacagctgatctctttggtgcatataatccatgcaattatagtgtgagcttctgctgtcagtggtggttaaaaatccatatacctcactccttttttagcctctgattttttttaattcaatttaactcatccttttattttaaaacttgaatttgaatgggttccattaacagatattttaaggtgacaatcaagtctagggcgctgccagcttgaagctgaacacagtccctagccctcaagctggatgtgagatctaatttagggcatgttgcaatgcagagatgtagctgatttgtaaacagcccttgtgacaacgtaatacagttgacaagtgatggttctcaggcagggtgaagtgtgttatctagctgtctgagtgatcaccctgattgcagttccacctggggttcatctcacagagccacacaggataattaaagccacagattcatcattggtagattcagcccattttagtctcattacagacaaatttagtcctgtcttcattcattataatgaaagtcacacgaagattcactttactataaactatattctttttcccttttaaatggaacgtacaagtgaatgttaaagtataaaagtacttgcaagtcactcgctttgctaatgagaatgtatgcaaatgtggtgcatgtttgcctttcctggactcagccctgtgacccatccctgtgtctgtcctgatggcagggattggtagataacttatgttggcccatctcttcccagagtggctagaatggtcttacggacatagaaggacatgttaaatattcatctggtttaattgaatttaatacacaatccttaagattaatctgcacttctggagttattaaatggctcactttttagtagcatatcatttatttgctattatctgagatagtgaattatttaagtaaaaagggaatgttctttccatgaggtggatcttaccaagctgctgctgctttcatttacaggcgattaccaattatattaaattaggaatgtgggtaaaaggaagcatggccgtctgaaggtttaagatgtttggttactaggtgttgcataatgtactgcaatctgggatctggcacttgctggttgacctatggtctgctggcacatgcattattaattatcgttttccatgaatattaatgatggttggatatcagtttaaagaatagtgaatcaattaacatgtaattttcatatactttgatttataaacatgcacattttaagatacatttgttttcttttagaacattaatttttccatttcagtttctcctttcccttgatactgactttttttttctttctttctttttttgagacaagtcttgctctgtcgccaggctggagtgcagtggtgcgatctcggctcactgcaacctccgcctcccgggttcaagtgattctcctgcctcagcctcccgagtagctgggattacaggtgcacgccaccacacccagctaattttttgtattttagtagagacagggtttcaccatgttggccaggatggtcttgatctcctgacctcgtgatctgcctgcctcggcctcccaaagtgtggggattacaggcgtgagctaccgtgcctggctgatactgacatttaatggtgtattggagtgatttatattttttcaggacaatttctgaagcgttgccaaaaatgctggttgtattttaaaattcaggtgatttctgtaagttattgaacaagaaccaagtgctgtacacatacctcagtctatttatattatagtactcttttctaccatggccacctacaacttaattttataatttgaaatgttactgaaccatgaaaatataaaagagcatataaccaacatctagctacccactacctagttctatcaaatgttgccattttgtcatacttacttctgatccttaaaaaaataaataagtagacttctgatttcagctcagagatgtagagagctgcaaagatgtccctcccacgcttccaagaaaaaatctggacagattggaaattaacagagaactgagtttgcagagcaaacgaccatttcaaaatctggaaagaggtgccttctgagacacaggacaggacctgagcatttgtttacaggagcagaagccaccagaccccatagaagtaggtaggaagattaagctagaaaatttgacaaattgctggaggctgagtgtgggctaacttgagagtgtgaagtcttgagggcagcagttgtgggggagggggtcctatccctttgcaggcttttcttccaggaaccccatttggctctaactgggagggtgagggaaaattcagagaaaactcatggtgctggctcaggaaccactgagcaatctacttagacccttctcctttaaggagcaaaaggcttattctgcagaggaaggctatggtctgagggccctggtgaattaaccattgcagatgggggatggagctccccttcagccccttccccactccatctcacctaaaaaaaaaggtctttaagcgggtggtagactgagaacattggtgatacctgctacagctgggggtttggggtgggaggagctgtatccctagggcaaatacgttgtgaagcctacaccttcaagacacaggcccgctgtgtatattttagagactgagacttgaaatattagagaactgcccttcttccctcaccccacctgcaggctagcaagcccccaggaataacagtgggttacagcagggagagctgcaagagacaggctcacactgggaacagcataaaggaaagccccaaagccaagagaggggacaaaaaaggtcactagaggaatttgaagtttttgatgttcataggaacaacaaacctcaacgcagctcaactcctgactagattaatatcagttccacactaagggctcatttaccttagtatctgctaccttctatgaaatgtctggctttcaaccaaaaattacaaggcatgccaaaaggcaggtaaaagcagtctgaagagacaaaacactcagtagaaccagatgcaaatgcgatatagctgctgcaacgatcaaaacacacatgtatcttacctagctctgtccactgagtgccctttctgtgacaggtgccattttaggagccatttcagaatgagcttaacaaggtctgagcttttagagagcttacactccaacagagtacagagagcttaaccacagacaagtgaaaagataattatagatagtgaaacatgcagccatgaagaaacacaggagaggaaaaggctagagtggctagagtggctggtggagtgtgtgggctgtttcaggtgaggagaagttggagcccacacgtgaatgatgaggaagaggctcctgccattgctaagagccatccaagcagagaacaagaagcataattgcccagaggcgtgaacaaggttggatcctccctcggtctgcactgttgccttggaaggtaaaaacgctatgggcatggtgctgattacagcaagctttacaattgtgttgctgtcatggccaacctctagggataaagtggtgggtgagttttctttaaacatgtgtaagaattacctgtcttcctccattttgagggacaaggagaatctgttagatcttgtttgtaaccacttcaggacctggtacagggtgaaaaggaatgtgaatttgcaattgtgagtagatactgcatcatttatccagtgcaactgtattgttctttgtattaactcagctactccttaccctccatcccttgccccaagtagtgattattcctatgttatagatgggaaaactgaagctcagagaggttgcctgacttgaagattgcagatctattaagggtcaacccagttatttgaactctggcagcctgacttcccaggattgtgttgtgagaactaattagaaggacaggtattcttaaaagtggagcctctgatgaaaaagaaaaccgaaaaccaaacatagttgtaaaattcacgtactaagtttatgtgaaaacattggctgctgaaactgcctaaggaaatggatttagtaaatgcatgttgaactatctatcacttgttcatttgtcatgagtgcttaaaatagatgaaaatgggtaaatagttgcaacgtcccaatttctgctgtgtcttactacacagcagaatactatacagtgttattgtatagtattaataccgtgagggcaatgttgtctgacacttccctacctggaacattctggaaatcactttttgtgatctcaataactgttaagtaattggtaccagtctagtgggttgttttgtttttgagatggagtctcgctgtgtcgcccaggctggagtgcagtggcgcgaactcggctcagtgcaacctccgcttccctggttcaagcgattctcctgcctcagcctcccaagtagctgggattacaggtgcacaccaccatgcccagctaatttttgtattttagtagagacagggtttcaccatgttggccaggctggtctcgaactcctgacctcaagtgatccacctgcctcagcctcccaaagtgctgggattacgggcataaactactgtgcctggcccagtctactgttttgtagactgcatttttcacctgctcaaatgcttttcatactttttctatagtagtgtttattttttgagaagatatgagacataaaataaatgaaccatattaagtacatgactggagagggagactgttacattggattaagaagatgcttgtatccattggtttttgtttttcaccattaggggaagaaaaacaccttcccaagagtacctttcttgatacaccaaaaggttgctggtatttggtaatgatatattcattgagggaaataccaggtgaatggagagttcttcaaccattagcaataactgagcacccactgtgtgcatagttcctttatctgtaccattcatgggactgcatgttagatgaggaaaacagcaaacagcaaatttttatatagcacttcccagggaccagagacattaagtaagttgcccaagggagcacagattgtaaatggcaggtctcgacgtgggctggtgggtggcttaactccagagtctgtgttctctcacccctaattgtactatggtatagcattgtctgggtggccttggctatgttcacaaacctcaaaccagacggtaattagcatgaggggcacccaaatctgtcaggttcggagaacttctgggagtcttggctgagctctgtgatagggtactgtgaggtgtttttttttttttttttttaatatgcagccatgtcttaattgaaaccacaacttcctgtggatgccttatgatgttatttgaacaagggaaataagcacatgaatctttaaaaagtttcaagtatgttgatttttaagaatggatgcaattagtagttctcattagctccacaaattatttaccgtggaatgctttggttccacataaagccctttaacgctaaaagattttgcaggttctgctgctttgactatctagagctgatttcgactggcagctttaaacatgcgcagtaatgcaagtgccgatgctgccagcacaaatggaacaatgtattgctttaatttaaaaaacaggctttgtctcatttttgactccctttacatttaatctgactagtcatgttttctaggaggatggtgagggtgagagcaggatttgactctgttgttcatcaataaagatcctggaaaaaactggaatgtgaattttgattgtgccctcccatttgtaaaggggaaacaaacaaaaaacaaaaaccctagaagattctgaggccagacgacagtgtagccttaggctgcctaaactcagatgtgcccttcttcctaggatcttgttaaaaggcagattgtgatggcagcgggtgggggggggggggtagggtttgggctgggggcgggtaggtttggggaagctgagattctgcagttctaagaagctcccagtcgatcctccttttagtagcaataatttctgacactttagacctagctctctatcttctggctgtgtggatcacctgggggagtttaaacaacacagtttctcacagccacaccagacctattgaatcagatctctgcaggggtgaaaccagcaggtatttggggaaaaaaaaaaaagctatagaaatcatttgataatacatctgccagctttgtttattggggatgggggagtaatgacagctttgaaaacttcactgttggaatcagattgagatgtttaaagttaagctttttgacatcctaagggcttccactccaaaactacatgagctatcttagcagccacccatcttggaagggaactcactagttctttatgagtatgtccaaactggcttagatcagagagagtggaggaaaaaaagagtacttaatggttagcttgctgacctgcctagcattagataatgtctgtgaaggcccctggagtgcctccagggaagccggggcccaaatatggaaaagagaagtcatgattatgaggtaggagttgcaattaccatcgtgaatatttaaagtgttatttcagctctttcctacgctcctgggtttggggtttcatttctttttcctttttttttaatatggattctcactctgtcgcccaggctggagtgcggtggcgcgatcttagcctactgcaacctctgcctcccgagttcaactgattctcctgcctcagcctcccgagtaactgggattacaggcacccgccaccatgcctggctaattttttgtatttttagtagagatgaggtttcaccgtgttagtcaggatggtctcgatctcctgacctcgtgatccgcctgcctcggcctcccaaagtgttgggattacaggcgtgagccactgtgcccagcctggggtttcatttctagcagtgtgtggggagccaggacaggttagaaagaagggccaggggatgtctttgttgtgataaagcagataccaccatggagttttgccactttcacggtatgattttattttattttattttttttgataactgagacaccccagcaagtgtcttcttaacatttcgtaaatcttactattaatcttttcccctgaggtcaagcaggaagataagacaccaggtagagacttagctttcgccctcctcaagctattgtgtctctcttttaacttggagtctttctttaaaaccaagtgtttcccagtgttgcgtgtgtgacttttcttaactccttacattatctaaggattaaaaaaataaggggctgggtgtggtggcctatgcctgtaattccagtgctttgggaggtcaaggcaggaggatcacttgagaccaggggtttgagaccaacctggccaacatagcgagaccttgtctctacactaaatttaaaaattagccaggcatggtggtgtgtgcctggcttggcacttgggaggctggggtgtgggaggattgcctgagcccaggagttagagaccagcctggacaacatagtgagacaatgtctctaaaataaataagggaaacctcacaatcagaaaaataaaaaaagttggacattccctgtcttccttttctgaagcttctacggtgagagatgttgtgcattgtcaccatgaacttctgtgtcagggagggttggagccgagaagcagagcgctaagtgtgatctggataagggatttcctgcacgttgtggaagctgccagtgcaagctgccccctgtgtcctgtactgagtctgaagtcgctggaggaaggtgggtgtggatgagagcaaggactcctggaacctgcctctggctctcacgcccccaacctcaatgacacagtgccctgtgggagagattggtgcccttcccgaaagagaaagattagcccagtccagtgggcatctgttgagtgtctgctatgtcttgagagctgttctgggccccgggggagagcatgaggggagagactgacctggaagcacacttttccaacccgttgtggtgcgtgcccagtacgctaagggagcacaaagggagggggacctaagagcctggggcagaagaggaaggaatttgatcaggtgaagaggacgggccagagcccagagcgagtgagaatgagggtatagtgtgagtgtgaacagaggcctacagcttgatgagtacctagaaataagccttgccagagtaaaatgggaagcaaggccagaaggtgagagggatcttgcacgcccttgaaaggaacttggacttttggggtaattgggaaccactgaggcaggattctaagcaggggtatgccgcaccgtcacatgtggatggaggaaagttccttcaatctgtgacctctcctgaatgagcacctgctcccaggcaaggtttttatttatttttattttattttaatattttggagtgcagtggtgcaatcttggctcactgcaacctgcgcctcccaggttccagtgattcttgtgcctcagcctctcgagtagctgggactacagacatgcgccaccacaactggctaatttttgtgttttcttggtagagaccgggtttccttgtgttggccaggctggtctcgaactcctggcctcaagtgatccgcccacctgggtctcccaaagtgctgggattacaggcatgagccaccgcactgagcctccaggcatgttccccactggccacccctccccgagacagagccttgctctgtcgctcaggctggagtgcagtggtgtgatcttggatcactgcaacctctgcctcctgggttcaagtgatccttctgtctcagtctcccaagtagctgggattacaggcacctgccatcatgcccagctaatttttctgtattcttagtagagacagggtttctccatgttggccaggctggtttcaaactcctgacctcaagggatccgcccacctcagcctcccaaagtgttagaattacaggcgtgagacactgcacctggcccaggcaaggttttagaaacagctttgaggtctaatttacatgccatgatattgacctaatgagtatcccagtcagtgctttttaatatatttacagagttgtgtgaccatcttcacaatctaattcttgaacatttccatcacccccaaaagaaacctgtgcccatttgcagtcactctccatttccacgctcagccctaggcaaccactcacctttgtaatttctcctttttctttaaggagaatgttttctgcaaatgtattatttactttaaggagtctcccaaattataaactcttactcttggctacccggttagttactgcttagcctgttcctcccagcacacttgagattgcatggaacagaaacctgtctgggactgccttaaacacagacatttgttattttgcataattgggaggctagaggtagggtggaccccaggggcagtgtgatcagctgctcagtgtgacatcagaaacctgtgttcttgctgtctcttcccccaccgtgttgttctggcagtagcttcacccaagggctggcttccctgtggtcatcagatggttgtagaatggtgtccatctgcagtggggccctttgcttccttgctcacagcccgtatgtaggaggagttatttcttgcagtctgattgggtgagctttgttccccctgcccaccctgaagcaatgattggcttagaattaattaggctgtccttcctagagctggaaatgggctccatgggggaatggatggcacctgtgaccaggagtgggctctgctggggaaggaggaagggagccagctctactgggtaggcaaccagcagtgctcactgagggttcctgaccaactgcattggattgtttgtttcctttcacttgggggccttttttatgttaaatgcaagcaaggtgatcctctgattttgaacttgttatctgggggaaggcagaccaatcccagttcatcctggctgagtgacagcggatttgatcgttgatctcaataggcttgagagtaataatatgtgagtatttttgaagctgaccctaactttacatctctgaaaagtatcaattcagatctcactaattcaggaggttctgataatttggtcaagaagttcgctgaagtttacctttgaacagttttatagtgagggtaatattggtgatggtggtaacactaacatatgtgggaaataaatgatttgagtaacattcgaaaaacctgtttgctttaggatagaaatatctaaatatacgactagaagtaaatagtagaaaatcattcctatctagttattaacttagtcccttggaatctctccttggggaaaaaataaaatcctgctctgactatgtcagtatttgaattactgtatgaacctgaaattaacaaaaatggactttcaagtataattcatgcttcactgagccaaatagacattctgccagttatttggactttattaaattttactttattacttatatgtaataaaaaatcaaggtaagcctctgctttgcgaagtcatttatttgattaggagctgtattttagagtgcatttcagggcgaggtttgtccacatgtaagtaatgaacgtttgctggtgcagctcgtaatggtgagaacggatgttgaagaaagcaaacaccatatgccctttgtttcccgtgcatgtcctcttctggaggcctgggtggagtgtttcagctgtctcaaataatctccattttgctgttactgcagactctgcggttctccagctctctcctctctgatgttaattataacttcttcctaattaggtggctcttcctcctcctcagtcatacaggttccacactctcaagtgccagagattggattacttttcacttgatttgcgacagaaataagtgcaaagaattacaaaaaaaccaccagtgtgagtgtgtagtgggaggggcaggcgggttgggtacgggacaggatgcttagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgtaagtaggccatacatctgttttgattgttgcgatgtctgcatcttttgtagcctgttgcccgactactttgtaggccaggagggaggcatgatggggaatttggtctcaggccagtccttccaagatggtgaccaacactgttttccacttggccccaggtctcagttttctggtttatagccgaagggtatttctttcactaagcccttgtctgtgatagaagtggattctttggctgagttccttttgtagtggcatttataaagattttgaatagctctgtcatctggtttggtggctctttccctctctgatcactatcgacagccaggtgagttttctccaggggacacggcacacagatagctgcattcaaccaaaccccctgcaggcatccatttctgcagtgaggtacccctctcaggggttgggagcaggtaacatttctgatgcagctggcagatctgggaatctaggggggaagccaggtgtggaatttagctttcctgtagtgtgaagaaataaagggggtgggggtaagaatgagatgggagacaggagagaaagtcagcttggggtctgtcaagagcactgtcctgttgccagatgccaactgaggtgtcgggagaggttcagttccccactcagctaactgtgcagccatgggctgctaaccaagatctctccaagtcttacttttctcatctgaaaatctgcatcctaccacctcgcaggactactggattgtttaaagtaatgaatgtgaaggcacctggtgcttggttgccatccttctccttttccatggcactctatgccataaatgcaagcagtgtgctgggctctgtgagatgccaccagtgttgctgtcctggcttgtttcaggccatcttttgtggccaccaagttctcatggtcagtgtcataggtttgatcttggggttggccagttggccttgcttaagtatgtagccccaggttgcccttttagtcatggccaggtgacccgcctcccaaaacaaggtcctggggaaagggtatgagtgagtcatggttatgtctcatagctaacgtttaagttaaagatgatgggaactgaggacccaagttaggaggctgtgttacaggtccttggggagagtgataattcaaaagacccctttcccgtccagctttgagtttccaacttattaaaacctatattcagccagagggagggagaaggaaaacaaaaggtaaacctcggccaggcacaatggtttatgcctgtaattccagcactttgggaggccgaggcaggaggatcgcttgagcccaggagttcgagaccagcctgggcaacatggtgagaccctgtctctaccaaaaataaaaaaaaattagccaggaatggtgacacacgcctgtagtcccagctactcaggaggctgaggctggaggattgactgagcctgggaggtcgaggctgcagtgagccatgatcacgctactgcactccagcctgggtgataggagtgagaccctgtgtcaaaaaaataaaaataaaaataaaccttgattgaaaactgccgagcagtcatctgaattctgattcagaagtacatgtaggacaccgtcatggtacttttccattgtgttgtttcatttaatgtgtttatgaatttaggcagccaccatgcacgtcggtcaagccccagttgcctttcgtgtgtgtgtgtgtgtgtgtgtgtgtgtgtgtgtttagggcactttctagagcctgctttgttaattaactgtactatgtgctttatatttgctgtgagttaattaccgatgatagtgttcccttgccagtcacaagttctctcacccctttcccccattgaattcctcatatttcatctcatccataggctcaagttgtttgtctttgactggcaagactcctcaataatcgtgtatcagtgatctctgacacagtgctaacttttatcactgattacggagagacattgtataaatcatcaggacagtttgttttgcgtatgatgatttaagagcacctcttaaccaacatcaaagtaatatatcagagtgccaaccttcggtacttttcttttgcttttcattgaaatccactttcttttctatggtctactgggcctcgtatggtctggctttgcctaccttttcagcctcatcggggtcatcttcccactcggccactgccttctgccatattgagttctcgcctgtcccagcactgtctctgcgtctggtcacttgcaattctcactgctgggaatgcccctttttttctttttggctccttgcttggctggccctttctcttctttcaggtaccactctgagcagccctccagggccatcttgtctcaagggccagcctccatcttgagtttcctttctccattcccatcacatcaccacatttatttcctttgcagtccttatatcacagcctgtaaatattttgttaactcattgatggacttggtatttgatgtctctcccaccagaattttagctccatgagggcaggggccttgtctgtcttatccctaccatatccccagctcttaactcaattctagatgcatagtaaatgctcaacagatatttgttgaatgaatagttgctttggataattaacacggtgaattacttttaagtagtttgtgactgcaagctgatagagccagtcccatgttttatgtggctggccccctccccatctgcatccatcactgctctggcactttgggagcatttcagaccccagggcactatttctctgtcttggccagcccctggctggtgtctgggataaccctctgttttaagcatcatttttgttctcaaaatgaaaaccacctgtcttcaacgtgatttgcttaaaataaatgctttatttctttactgagaccttcttccctttctgcctttctccacctcctgccaagaataatgtgaaaaaccccattatcttggaaagtggttttccctctggttggaatacaaagccagatgacttaccaccaaatgtgctgggataatagctttcccctgccctgatgctctcagatgttagtgaggtctcgaccttggcacttcctttctttgtatatttccttgaaacttccttcctacaggtaaagaagctagcccaaggcaccacctaaatggcagtgggggtagggaccatgtctaagtagcactctgtggcagactgtttgccagctcactgacaccttacaccaattccagggagttgacagtttttaccaccattttagagatagcaaaatggaggctcactgaggttaggtgacttgttcctaagcacataggttgcaaccagccaagatcagaaaccaggcttgtctgactcccaaattcatcttttatttgttgatgtactcagtgtctcccagggctatatcaaccaagttctgcagttaaaaaaacatctggcaacctggtctacggtacacatcccatgtaactgaggtaagtttcctgaaacagtagctgccttcactgtgtgtgatgccctcttgtattctccattccattcaacagatgcttgtcaggaccttctaaactgattacgtggcccaccgattggtggcagtccatttgaaaacagtttgagggacattagtgtaggtgaggtgtaaactatgcttagtttatatagaggtttacatggtgtaagctattaaaaagaatttttatggcaatataatagacatacataaaatgcgcatgagggtacggctgttgaatttttacaaactaaacacatctgcataattagcacgagatcaaaacacacaccattgatttaagcttctttgaatcaagacagaggcatgaagtacaacagaaactgatagcccctcagtttgttgtgaattacgcacaaacagcttactccataggcagactctttttggaggtccgtagcttgcctttccagtgatggggtctggctggtatttgtttgagatctaagaattgccgaaggagtggaatatggcctctgtaatggcctcagaaattagcacaaaaggagggctgactgagaatgtgcctcgtaaaatgtgaacatggaggaggaggaggaggaaagggcaaggccccgtagttgagtacagaaacattagggtgtgagaatttgtggtcatagtaattgagaccaattttactgaaatggagggcggcaaaaggaggaaggaaaaggaatttgtgattacagcaccaagcccctagaggttaaagaacgtctctgtaaaataaggaatatctacctctcatggtgagtgttgacttttagagaaaattgttctagtatactgaactaaaatgcttaattcttggcaaaagatacagatgcatctccatgcaaaagcaagctaaagcaactttgctttcataatgtatgggttctgtaaagctgtcttggtggacatgccatatgtaattcatcataatggggtgtgcatagaaatgaaagggagcgaatatcgtaacatgccttgaagcattgagtgctaagttacaaagggcattaattaatacaacttaatgggattcatttatagctcacttttagtcaaactgaaatagctttcctgaatcagggactttgggataataataaatccttttgtctttgttgatcagataagctcttattcactgacttcctgttactttcttggcacccagagtcatgcctgggcactaaggatttgctgaatgaatggaaggagtaaggacaaaaaaaatcgtagctagcatttaatgagtgtgtactgtgtgctttgcctcttttatctgatttagtcatcactacaaggctgtgaggcaggcactgttatcattttcttctttattttattttattttatttattttttgagatagagtcttgctctgtcgcccaggctggagtgcagtggcgctatctcggctcactgcaagctctgcctcccgagttcatgccattctcctgcctcagcctcccgagatgctgggactccaggcgcctgccaccaagcccagctaattctttgtatttttagtagagacggggtttcaccatgttagccaggatggtctcgatctcctgacctcgtgatccgcccgcctcagcctcccaaagtgctgggattacaggcgtgagccaccatgtccggcctatttatttatctatttattgagacgggatctcactctcacccaggctggagtgcaatggtgcaatcacagctcactgcagcctcgacctcctgggctcaagtgagcctcccacctctcagcctcctgagtagctgggactatagttgcacaccaccatgcctggctgattttttttttttttttttttttgtagagacagggtttcaccatgttgcccaggctggtcttgaactcctgggctcagtgatctgcctgcctgggcctcccaaagtgttgggattataggtgtgagccaccatgcccagcattatcccttcttttagagccaccttatttcctctacttgcctggggaccgttctggtgtatgcctgttgtcctcgcattaacattgacatcacctgctttcattctcagatgtcctggtcagatgataaaccatttcactctgaaatgttctggtttggatagacagatgaggaaactgagacacagagaagccacatcactttccatggtcaccaagctagtaagatgtaaaggtgggattctttcctgggagtctgattccaggtcatgttgtctgatcactaagttctggtgcttcacagtttaagccaagggagagataatataggaaaaccactctttatgtttttcagcttcagtatttagtaaaaatcactgccaagttagcatctgaagtaggttaatgtgactcagggcagtgggaatgtgctaggtaaagactcattgaaaccctaagtgtgtgttcattagtaaacttggccaactactaccctagaatgataatagcattcacatgtgcatggtgctttatagtttacaaaacctcttctcccatattattgtgttgaagcttcttgtgcactcagaggtgggaggtggatggccagtggtgggatttccagtttatagaggaggatggggtaatcagcaggatagtacagttgcctgcctgaggcttcacggctagaaaagaggcagatccaggattcaacccaggtattccgcctcagcgatcagtgcattcccactttagcacgggtgcctcttagccagatatatatatatatatatatatatttttttttccttgagacaatgtcttgcttgctctgtcacctaggccagagtgcagtggtgtgatcacaactcactgtagcctcaacctcccaggctcaaacaatcctcccacctcagcctcccaaatagctgggattacaggtgtgcaaccaccatgcctgactaattttaaaatttttttaagagatggggtcccactatattgctcaggctggtctggaattcctgggctaaagtaatcctcccacctcggcctcccaaagtgctgagattacaggtgtgagccacccatgcctggcccagatgctcttatatagccatttgagggtgctgtttatgaagggttagggagtcacttgaagactcatttacccagagtttcttagccttggcactgttgatattttgagccagttaagcctgttgtgggggctgtcctgtgtgttgtaggatgtttaggagcatctctggggtctactcgctagatgccaatagcacaatcgcccgtcccgcccctgcccccaccccccgcccccgccagatccctccaagtcgtgacaacaaaggaaagcgtctccagacattaccaaatgtcccttgctggggcacaattgcctctggttaggaaccactggcctaacataatagccacatttaaaagagggaaagacgaccttgaaaatgttagacctgtcttcttcccctttctctagtttctaaagcatcagaaaaactgttgaaagacctgcaaaggggcaaaatagagaacaagcaacatgtttcatgttgaattctcttccgtggaagagcattgtgtctgccaaaggataagatagccaacatttttttaagttaaaaatcacacagttaaaaatgttttgatagaaaagttagaatagagatcagccaaaatatacatatgcagaatctcctgtaatcctactgccgagataaccatggttcatattttggtctatttccttctaaccttttccagcatgcgtatacaagtatatattaaaaaaataattttccaaatagagccataccaaaagctgttataaacagctttttaatttaaatgtgccacaaatacctttccatatctatgatacagagttactaaggtttgtagtattttgttgtatggctagcatatagtttattcacttagtctcctgttgtgtacgtttggtttgcttctaattttgtttttgctgttaacatgcaaaaccgtggtgagtatccatgtgcatacttacaccctttccagcttattttttttccttctagaagttaccatcactgtaatttttagtatccattgagtaagatattgaattcatagtgttctggattgtattttaattatgtcacatacctttacccctcaaaattacggaaatgtattgattaaaaatgtgtttatgtgctagacttgcagaatggggtgtggaaagttctttggttttctgattgaacgatgactaataagaaaccatttgggtttcgtgccttgttcatgaagcccagtcttaactgtgtcaggctacttcctgagtaggaatcagcccagtgaaggttgcttaaccgtcctttaagattctgttcactactgaaagaaattcaaggctatatgctcgtgaattctcattgctcatggatttttcttctatgtgttttaaattataaactcacggaaaagacattcagatggtagagaagagcataaagtttcctactttactcccctccctcttggtttttttttttttttcattctctaggatttttgtatgcttgtacaaatattgaaatacaaaaaaatttaaaacccacaaattgggcaacagaatgcaatgtgtgagccaagtagcttttttctacttaatgcatctttctatatcagcaccttattctgtttaattggtgccctatttggggttgttttcagcttctcctgcaacaagtcaccttctattatgagtctatccataggatacatgcttagcagtggagttgttgggttaagagtttatgtccttatggttttgatagatattgctaaattgcccttctaccagcaatatatagcttgacttgtttctatcaggcatttttttcatgcctggcataaattattgattaataagctgggaacacaaaggtagaatctcatctataggaaggagcatagttggttaggagaccatgtcttccctaatgaccattatgagtattggttttcagccttgagcatactcagggggatgtgtatttactggtttcctcctggggttggcctgaaactggcttttacttttttcaaccacagagttagaatatgcatataaagttgggagacaatacccagatagacaactttctgggagtattcgatgacatgcctcaattagaattgaggtggttagaaatggacccttattactaaagaggttgtgacatgtaaatatcagtgggtctctgaaatagaagcataggtcatttggcatttggtacactgtatcaaatggaacataatataataaatgtaaatgtaacatgttataatcatgttacagtcattactacccctcttatctcttccatgacgtcttttctgatgtttcttcattccccatcttctcccactccaagatgactttttttcacactgtccttaaaaaaaatatagctggtactgcatttagggctttaaattgttttattatcttggatcagatatgtatccctaatcaaattttaaccaacacttggtttctggtcctcttcactctggctgggtgtttggaacgtaagtattttgattggttgtccactctagaattcttctgatttcatggggtccctgtgcttggtaaaggagggctctctcctggacatctcccccttgtaggcccccagaacggtgctcataaaggactctgtcatctcagtcttcagagcactgctttcctgcctagggaagggcacagcagggtgccatcttttatatgatttggtatctgaaggagcagaggatggtagatgtttgaagatgattctgtgaaccctggtgggtacggcagctgccagagcccaggtaaccatgtgaagggctcatattttctgaaaagtcagggctttctgatgggcactttttagggtattcttggccaggatttttttttttttttttgagtcggcctgaagtgtcctggaaggtggaagctaaaatccatgtaggtttggcctcaggctgggcctcttagaggaggtggggcagctttcatttcctttctccttgagccccgagggctgacactgtgccctggggactctccctggcctttcccaggggatgacctcgagagagtcttaaaaagggaacaaaccaaaaagctgttatttatttttcttattgttcagataatatattttcctttatagcaaatgaagagggcttttagggggcaggcagtgtgatctgaggaaaatggcctctggggtcaaatagttctgggttggaatgtgggctctgtggctttttccctaaggggctattatgggccaaattttgtccctaacccccctgtacctcataatgtgactgtctttggagataggtcctttaaagaggtgattaagttaaaatgaggccattagggtaggccttaatccaatctgactggtgtcctcataagaagaggagattagggctcaccgagagataccagggacgcagacgcacagaggaaagaccatgtgaggacacagcaagcaggtggctatctgcaagccaaggagaggggccccaggagaaacccaatgtaccttgattccagccttcagagctgtgaggtaatgaatttctattatttaagcccccctagtctgtggtattttgttatggcaacctaggctgactaagatgggggcttttagcaagtcaggtcccctgattttgctttcctaaagagggaccacaacaccctgagttgacaagaagagtggacacagtgcctggcttctaggaggtactttcaaatggcagtggtggtggtcaccataatcatttaataatatgataatagaaatcaccacccccttccctcacccaagttttctgaccccgtctggtttgaggtttttctttttctttctttatttttatttttatatatttttttgagatggagccttgctgtatcacccaggctagagtgcagtggcgcaatctcagctcaccacaacctctgcctctcaggttcaagcaattctcctgcctcagcctcctgagtagctgggactacaggcatgcgccaccatgcccggctaatttttgtactttcagtagagacctgattttgccatgttggccaggatggcctcaaactcctgacctcgtgatccgcccgcctaggcctcccaaagtgctgggattacaggcgtgagccaccgtgcctggcctctttttatttttttatttttttaactttccttttaagtccttttcaaagagggttgcaaagaactcatgtgatcagagattggtactttataggttgagtgaagtattttcttttgagtaacccttttcatccttttcatctgttaacatattggaggtccaggtaaaattgtatttaggacaaggattctgctgccaaaatagattcaaagtgactttcagcgtggtgtgaatatttactgtacctgacacccattgtattagtttgcttgtgctgctgtgacaaagtaccacatgctgtgagtggcttaaccagtggaaatttattgtctggcagttctggaggctggaattcagagatcaaggtgtgggcagggttggttccttctgagggtcgtgagggagagtctgctcctccccttgcttctggtggtttgctggcgatctttgggttgtagacacatcaccccagtctctgtcttcatcttcacatggcattctccctgtgtgcatatctctgtgtccaaagttcttcatttttgtgttttttttttttgttttttttttttttttggagatagaatcttgctctgttgctcaggctggagtgcactggcacgattatggctcactgcagcctccatcttctgggctcaagtgatcctcccaccttggcctcccaaagcgctgagattacaggcgtgagccacagctcccatcccaaagttctcctttttataaggataccactcatattggattagcgccactcaaatgacctaattttaacttgatcatctgcaaagaccctatgtctaaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgtttcctattctgtgtgcagagcatgccaagaggattcaatttgttgaatttggatctttttttgcaatgagtcactatttgattatgattttacaacaattcacagaatcaaactggctagaccccttctctgaaggacatcttgggtccagaaaacctgtgaatcatgaataagggaaacatttactaatgctagttaattatcagtgtttgttaaatatgttctccttgctgaaactgctaggggctgtgcagaataccgaaatagaataggcaatagctgtggcctccaggaacacacaattcacatcaaacagccaaaaaatagataatacatgcaaagtggtgtgagaaggtgtagtacagaaattaagaagaagtgcttgttgtggaccagaaagatcaaggcaggctttgctgaggaacttagttaggcttgggctgtgccttaaagagttagagatcccaggagaggagggagaataccagctcaagacaatattaacataatatcattaagctgtataatagtcacagtatatattgaactaccaggttttaataaaaattttcttcacaagatagatatgaaatgatttgtaacagaaaaatattgtatacatcctaaatgtccatcaacttgggatatataagttatagtacatccatatagtagaatactctacagtcagaaaaaagaatgaggatgctttttaccgctgtggaccttccaaatatattattgttcagtgagaaaagcaaggtgcaggacagtgggtatgatatgctaatgtatgatattttcttaaagaaactagaagttgcctaagaaactaataacctatgtgtggtagtggtagactgggagaatgggagctagattctgtgtggggatgtttgtgtgtatgtgtgtgatttgaatgatgtaaatgtatcctattcaaaaagttaggtgtgaagacaatagtatttggtcacactgttgctacccttaaattgacttagtgctttgccttgctgggacataataaacgaagataattagtgacaccagatatcttagagataaacttttgcatttgcccagagaatgaaattcccttgaccagctttcacttttgttggccgccacaagaaaggtttgaagcatagcactcaatagaggggctggtctaatgaacccctttttacccatcgtctagcttcagcgttatcatctgctggccaatgctgctttgtttgttctctctcctcctcattcttcccttcttccctggccttgattattttgaaggcaatgccattctgatggaataatttagaattattactctgacctcctgagtcccaccatggccccagacatgcagagtacattagatgcttaggtgggaaaagctgtctttaatggaatttggctcatcacattaaactcatttgattttacttaaaaaaatgtaaaaaattattgtgcaatacaggtaacataaaatgtaccatcttagtcatttgaagtgtatggttcaaatagcactaagtacatgcacattgttgtgccactaatcttcagaacttttttatcttgcaaaactgaaactctgcacccatgacacaccagctccccatttccccttccccccagcccctggcaaccaccattctgtgttctgtgtctgaatttgactcctccaagtagttcatgtaagtggaatcatatatgatttgtctttttgtgactggcttattctacttagcataatgtcctcaaggttcatccgtgtggtagcatgtgacaggatttccttcctttgtaaggctgaatcatatcctcttgtatggatataccacattttgtttttccattcagtcattgatagatacttgggctaactttactttttgccccctcttagaatataaggttttatggctcataataatttcatgctgtagcacatcagaatgcctcagcacactattaccctccagttaagagaataattctgagcagtttgagaatatatgtatttttgagacagggtctcactctgtagcccaggttggagtgcagtggcgcaatcttggctcactgcaatctccgcctctctggctcaagtgatgctcccacctcagcctcccaagtagctgggaccacaggtacgtaccaccacgcctagctaatttttttttttttttgtattttttgtagagaccgggtttcaccatgttgcctaggttggtctccaactcctgggctcaagcagtccgctcacctcatcctccaaaagtgcttgagaattcttataccaaatactttgacttgaaaaaccagcaaattttcctttctgcttttgtgaccaagggcagcattttctctcaaagctcttacattgaattttgtctctcaccagactagattatgaatttagagagactagggcagggggtggggtgatatcttcatttgcccagtacctggcactgtgcttggcactgggtggatactgtgtatgtatttgttggaggaggagtgttactttgggcaaggcatgtacctatacctttataattaggaagttgaaccagatgaattctaagaccccttttggttctaacattgtttgggtccatcattaaacctgaaaatcccaggctgggcgcggtggctcacacctgtaatcccagcactttgggaggccgaggtgagcagatcgcttgaggtcaggagtttgagaccagcctggcccacgtggtgaaaccccatccatctctactaaaaatataaaaattagtcaggtgtggtatgcctgtaatcccagctacttgggaggctgaggcaggagaatcacttgaacccaggaggtagaggttgcagtgagctgagatcgcgccactgcactgcagcctgggcgacagagtgagactctgtctaaaaaagtaaaataaaataaaataaaaaataaatctgatgatgaaaatttcagactctctggaatactggagatttgggggaggtagtgaaatttttggatagacatattttcactgcccctcaaatgatacccagaggtggtcacctacaagtaaacccatgtcaggatatagtgtttcttaaaataacattctggatttgggacttcctctttgtgcagtgggtgccattctttgaataataaaaaagctaccatctaaaaagtgattttaagtttagcttaatcgtgtaccacatttcctagatatacacggatagaaaacaaacctcctcttgacataatcatctttataatgaatctcatcggaagtcttaatggtaatcttaccatgagaagaagtcaaagcaatgagcaactgaggaaaatgaaaattctggaattagagaaaaaaatgctgataagaaaggacagatgtgatctgagtactgaatcttgttgattttctgaactttatgctcatttgtacatttttattttaagcctggtttccaaaagtctcttgttagcaaccagatggtcgtcaaataattgatacgggttcattttaagcccatttgaggaacataatggcctgaattttccagtagcagggtttagtaattctgctggtctttgaatgccaacagggttttttggaaattgagttccctaatgtcttggaagtaactcttggaaaataggaaccagtgaattgattgcatgatgtacttggaataaaaagttaaggatatggtttattttggctaaaacgtccacccttagaagtggttaaatttgtaaaattaggtgaggatttttgtgtgtgtgtttaagtttttttttatttgttttctgaggcttgagttaatgaatatgaatagacatttcgaatacactaatctgatatttcccattttcagagatccgttcaaactctagggtctgtgcacgtttttacttacatctgggagctaaaaagtctgagctcagaaacagagtagaattatggttataagaggttgggaagggtacagagagaggagggtagggagaggttgattaagggatacagaattacagctagatgggaggaataagttctagtattctgtggcatcataggctgactataaacaacagtttattgtatattttcaaacagctagaagagaggatttcaaatgtttcaagcacgaacaaatgctcagtgtttgaggtgatggatatgctaattctgatttgatcattatacattgtatatatgtattgaaatagcacatgtaccccataaatatgtacaattattatgtgtcaattaaacaaaacactggggtttgctattctaaagtcttactaaatgcttttcaaagaaagaaaaactccttaaagtgtggtttgcaacgagaaaaagggttgtgagctgcctccagagtcagtgagactcaatggtcattttgttattgtttttgagacagggtctcgctctgtcacctaggctggagagtgcagtggcatgatcacaggtcactgcaacctcgacctcttgggctcaagtgattctcccaccccaaccacctgagtagctgcacagtgcctgtgcacgcgccaccacgctggctgatttttgttgttgttttttttctcttggtagacagggtttcgccatgttgcccaggctggtcttgcactctgggctcaagagatcctcccaccttgtcctctcgaagtgctgggattacaggcatgagccaccgcacctgacctgttatttgaactggagaaaggcatcagcaactgttttgggggtgctagtgagccgcaggttgtattgctggaaacagtgaaagagagagctgaggtctgtctgaaaagcctcatgaactgtcagagcggtgacagagcagctgtgctatggagaggtactcctttcaagtgctcttttagttggtattctcagaatgtcactaggtgtttccagcagaatcccatcttgcgaaacgtgtctgtcctgggctctctgttttggtgtgtgcgtacaaagccttcctttcctctcctctgctcacgccaccatggctagccagtctctggctgtcttgggatctgagtggagctcctggtggaaccagacccagaggcctcattggtggacaggttagttttccttggctaccacaacaaatgaccacaaactgggtggcttaaaacaacagaaatttattctctctgatttctggaagccagaagtccagaatcaatgtgccctccaacggtgttctaggggagaagccatttcttgcctctcccagcttctggtggctcctggctttcctttgcttccagccgcatcactcctctctctgccttcctcttcacattgccttctcctctgtccatcttctcctctgtgtgtctcatatgaggacaacacttgtcattggatttagggacccccaggataatccagaatgatctcttcatctcaggatccttaactacatcagcaaggaccctttccccaaataagatcctgattctgggaattagaatgttgacatatctttttagggggttgccattcaatttaccacagtaggagtagcaattcaggatggggccttgaaaaggaagcagaagaaacagaagccttcataatgtgatagtttaaaaaatctgcctggtcatttaaaaaaatccttcagaaagtaactttattgaggcacattttaaatatcatgtaattcacccatttcaagaatatagctcaatggtttttagtaaacatacccagttatgcaaccatcatcataaaatgctttagaacattttcatcaccccaataacatccacatccttcatgcccatttattgttaattcccattcccactcccagcttcactgcctgctgtctgctgtctctctagatctgccttttctggatgtttcatatgagttgtttttttttttttgtgaccgagtcccactctgtcacccagactagagtacagtggtacaatcatggctcactgcagtctcgacctcctgggctcaagtgatcctcccacctcagccttctgagcagctgggaccacaggtgcatgccactatgcttggctaatttgttgttgttgttgtttagacgggtttcactatgttgcctaggctggtctagaactcttgtacttaagcgatcctcccaccttggcctcccaaagtgctgagattgcagacatgagccaccatgcttggcctaaagttttatttaaaacttaagaaaacatttctgattgtaaaatatggagaaggacaatcccatcacctggagcctgttagaaatgcagaatctgcagtttagcaagatccccaaggcattctctatattagacttagacatactggtacattgtatctgctatattgatcccttgtccacttaatatattatgagcacttccccaaaagtattatatctcttctgagaacattttaaatctcattgtaagaatataccacaatctatttaactagccacttcatggcagacattgtttcccatctttttttgcccttgaaaataaagctgcaataattatctttgtatagaaatatttgtgtatagttttatatctactgtatcagtaattccatttctaggaattgattataagacaataattatagacagactgctaaaatttagaaagtgcatatgtaaatactgatcagtggagtcagtcatttaaagtgctgttttccagcatggtactggtaccaaaacagagatatagatcaatggaacagaacagagccctcagaaataacgccgcatgtctacaactatctgatctttgacaaacctgagaaaaacaagcaatggggaaaggattccctatttaataaatggtgctgggaaaactggctagccatatgtggaaagctgaaaccggatcccttccttacaccttatacaaaaatcaattcaagatggattaaagacttaaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaagatgtggagaaataggaacacttttacactgttggtgggactgtaaactagttcaactattgtggaagtcagtgtggcgattcctcagggatctagaactggaaataccatcccattactgggtatatacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtcaactattgtaagaacaaaaaaccaaacactgcatattctcactcataggtgggaattgaacaatgagatcacatggacacaggaaggggaatatcacactctggggcctgttgtggggtggggggaggggggagggatagcattgggagatatacctaatgctagatgacgagttagtgggtgcagcgcaccagcatggcacatgtatacatatgtaactagcctgcacaatgtgcacatgtaccctaaaacttaaagtataataaaaaaaaaataaagtgctgttttcctggaaactagacctaaagccaagcagataataggaaatgtgaacccccaatacatgatgttagcacatcttgctaactctcacctccttctcctcctccttttttttttttttttgagacagggtcttgctgtctcacccaggctggagtgcagaggtataatcatggctcactgcagccttgacctcctggggtcaagcaatcctcccacctcagcttcccaagtagctgggactacaggtgcacactatcacacctggctaccttaatttcttttctttatagagacagggttttgtcatattgtccagtctggtctcaaactcctgggctcaagtgatctgcccacctcgccctcccaaaaggttgggattacaggtgtgagccactgcacccagccacctccatctgcttgagcattggtttcattgttgaacaaaatgaatgagcaaataatgaatgaatgagtgaatgacaatggcatcaaaaagtgaagtgtaggttgttactgagcagcggtgaaatagaaaggaacaaaatgctggacccacatgtaatcactttcttatctgttgtaattttatccttactcaatttccaacctccactagtcggttctgcccttgtaaagcagcccaatgtgtcactcctggaagcccctgctgcttcaactatctgtagcacactactcctcataggtggaaagtcagtcatgggagtgacgataccttcctcagatcacacctactggcctttcgattccgttttcccacttttcacaaggattgtagtctcttgaatatttactggccttcctagttctcagatccttgggaagtatgtgaagaggtcgggacttgtgtattcacttcgtatctgcccgattgccaggctccttaggtcaaggaggaattgagtgagttccaaggagagggtaagtctgaattttcccctttttttcttttctttttttttttttttttgagatggagtcttgctctgtctcccaggctagagtgcagttgcacaatttcggctcactgtaacctcagcctcctgggttcaagcaattctcctgcctcagcctcccaagtagctgggattacaggcgcccgccatcgtgtccagctaatttttgtatttttagtagagacagggtttcaccatcttggccaggctggtctcgaactcctgacctcgtgatccacccgccttggcctcccaaagtgctgggattacaggtgtgagccaccgcacccggccgaattttcccctttcattttctgcactgctgtgttctctgagctttccactgctatagtgtttcctgatgagaaggaagtgtttcctccagcttttttttcttcctggaggagtaggatatgaaggaatccctgcccccacacggggtgggatccagccagctgctccagaggatctcggcccctcctgtagcctcaaccttttttgtttctctgggtggtgactctcacaccagagcatacgttagaacctcctggagggcttgctcaaacaccgactgctggaccccaccccatgccttctagttcaatagtctgggctggggccagagagtctgcatttctaacaggttctctggtgatgctgctggtgtggaactccactttgagaactactgctctggcccacccctcattgcccctcttcccctgcaattgcttccaagtaggcagaataaggcgctggaggactggtgtgtttgagacccttgcatctagggagcccgtccagacttctaggggtagcgcctagcagtggtgtgtgcctgttccaccaatgaatgcagctttagacaggcccttcagagtataagaagcagtggctcattcaaattccttcaagtagtgggggtgagaactagggggttaaaaacagagccccaggtccttaaggcttcacaggaactcatccagaaagccagcaggtatgggcaggctggggcctcagcctgccacatgcctttgtgtttcagctggcccaaggctgtactgaacattataacctttcagccctggccctttctgttgacttcctctcctctcctcttggtgggattttcccctgtatttagggcagggcagtttcttctggaaggatccctttggctccaggctctgtgtctaaccctcccacttgaccctgtagcacacagccctggccagttgctggtggaagctgcagtccttagtgaaatggggagtggactgtggttcctcaaattgcattgtcatttggaggctcaagggcataccttttttatcctcaaaggcttaaagacaactgatggcagctggagagggttaagggagatggaggaaatcttcattcaagtttgtcttgctcagtgatcttttaatgtgtctttccagtcttggggtggttgtgtggtctttcagtacagattcaggtggcaggcggttggtggtttggtttaaatcagaggtatgttaaaatattcaggatggtgagggtgtctgtgaaaactaagagaggaagtggcttaaagagctaggctgtcagctgggtgcagtggctcacacctgtcatcctggtgctttgggaggctgaggcaggaggatcacttgaggccaggagtttgagaccatcctgggaaacgtagcaagaccttgtctctacaaaaaattaaaaagaaaaaattagctggacatggtggtgtgcgcttgtggtcccagttactcagtaggctgaggtgggaggatcacttgagcccaggagtttgagattacaatgagttatgatcatgccactgaattccagctttggtgacagagtgagaccctgtctctctctaaaaaaaaaaaaaaaaaaaaaaaaaaaaccaggttgtcaagctagatttagaattctttttttaaaaaaaattcttttattttttccatgggattctgcttgatatagacttaattctgttgtctgttggcccagggacatcactgcccagtggatacctcatccactcccactctttttgagggttttctccagggagttgaatctgtgaggcagtctttccctcctgctttcatttctcccccagcatcttctcttaggccctgctaggccacttgagcaagaatctcaggccataaaacatttccacatcagatttcctccaacagcacagggcgcttatggctcacatgtggaagcgtggacattgacatgttattttgagacttctgactttagagcattttgaggaaagtatcttctgaggtctttctttcctgtaagctagctgtagtagccaattccttttgggggatgggggaatgaattcttggcacactctgttgtcctttgggctagtcacatttgtgctaaatatcaggcgagctccctgcggacaccatgggatgaggacaacatcttattcttggcaatttgcaagggacaaattaggctgtggtacttgcaagtagaattattaaatatcaatgggggataataaatgtgaagtagcttgcaaatcttctgatattatggctgtttcagtgaaaacacagctgctaagatactttcctagctgtaatcgagaaggtaattttcctgaaaggccatttaaagcagatctttagtgcctttggctcattaagaagcatgaataggggtaagtctctgaaaaagatgaattagacacagagcagaggagcggtggtgtccatgatgcaggatgatggtgtccagggcctgcgtactccaaatagaccaaggactaattagttgtgtggtttattaatggactggagtcaatcctggactaatacaactaattcttccatttagagttaatgttggcactcaattttccctggtaatgagtgagttagagtaagcaggcacgtgagtgtaagatacagtgctaatattttgtgagaaacattgaacgaggcttgatgtttaaatcaatagttgaaaatgtgggggaagactttccagaaaaggcttacaggctaaataagagcagttaattgaaagcaaaccaagcccacccaatatttagatttgtttagaaaccaagtgaacatttgagatgagaaacatttctctagttctgtgatgtcgtcggctttcctggtgtgtttggagcttttgacattggtgtggtactttacctcagtgaggctgatggaacagagtggatgttacagggcctcaatttcagaattcttgttgtgtactcgtgaagacctgtggagagattttgcctcaagtcagtttggatggtttctgccctccagtctgataaagtcccctgatgtcaaaccacaggtggaatttccagagactgtgatctgtggactggtgacaaatcctttgtgaaaagtctgtgtgacactactaaacagagagggcttgggggaggagaatgaggggaccaatgcgctcccctcagaagccttgatgctctcatagaaggtctggccaggtgtgggggtctagctttgtaaagtaggaagacccctttgatgattactttttttgtctagttaaacctttttggatttctctgtaatttaaagaatataatttttaaaatgtaaagctgaggattcatttttctatgtgttaataaagttaataaaccccccatatttattggggaaggcagtataaactagaatttccttaggtttcttctttctttctttctttctttctttctttctttctttctttctttctttctttctttttttttgagacaggggagtgcagtggcgtgaactcggctcactgtaagctccgcctcctgggttcacgccattctcctgcctcagcctcctgagtagctgggactcctggcgcctgccaccacgcctggctaattttttgtatttttagtagagacggggtttcaccgtgttagccaggatggtctcgatctcctgacctcgtgatccgcccgcctcagcctcccaaagtgctgggattaaaggtgtgagccaccgcgcccggcggcttaggtttcttaaaagttaaccaagtgagcatcactgaagattaaccaaaggatctatgcaaagatgtatttttattttgctcaaacagttgtttataaaaggtaagatgaaaaccaaagcacacattacagagtaggaaatcaagtacttttatttcataccagaaataggaggaaaaggataaaatcagggtgaagccctaaaaaaaagacagtcaaaaaagaccctataggagggctgggagagtttttgagccatgaggaccatttgaccttggtgacagggcagctactgagttcccagaattctgccttttcaagccatgtaacatttgcaaatgctgacaaacagctgctaattccgttttctatgaaagggtgacagggtgttctcaggacatgagcttcttctccccagagccacatgcctttcacacagtgacagtggcaccatcagtgaggacctgggaaggagacaccagtccagaaaaatgatgattcttttttttttttttttttttttttttttttcgagccggagtctcgctctgtcgcccaggctggggtgcagtggtgagatcttggctcactgcaagctccgcctcccgggttcacgccattctcctgcctcagcctcccaagtagctgggactacaggcgcccaccatcacgcctggctaattttttgtatttttagtagagatggggtttcactgtgttagccaggatgatctcagtctcctgaccttgtgatccgcctgtctcagcctcccaaagtgttgggatgacaggcgtgagccgctgcgcctggctgaaaatgatgattcttataggggggtgtgtgtgtgtctgtgtgtgcatgcacgtgtgtgtgtgtgtgtgtgtgtgtgtgtttgtgtgtgtgagagagagagagagacagagactgaattgcttgagaaaatttgcatttgagttcagaagtatgagcccacatctgtgaaagcagtaggtaagagactagtgaatgcagatgactcagatatgcacacaaacctgtggatttacggttttagaaaatacaaatatacattgtgctaaatttgaataatttgaagtgaggtacaattccaaagagcaagttgtgatctaggacaaaggaacctctgggatgagtgacagctcggagagccagaggtggaaggaggaatgaaacacagctactaaggctacctgtgtcatgggccaccctggaggctgggagatctcttcttatgggtttctctcctatttgtgtctgtgtgcctatctgtattctctatgtgagtctctatgcttgtgcatcagtgtctctgtgtatgggggttctgtttttctgtgtctatgggtctgcctctcccactcgctgtaaacgggctaccccagaaacacttgccagatggagcacactggcctgggtcaatgccacatatggtttcttacaagttgcagaaaggttacacttagcaaaaatgggtgtgccccaaagccccacacagtgaacaggttttctcatgatcttgtcacacctgtcacaagagtgggggaagatgaggaggaagagccagctggaagttttagaatcgtgtttaatttgtggtttacatcctcctcccgacccttttccctgacaaaccacccacacacttttcactttgcattacatttgtcctcgcccatctccatgggatattcctagaattctgaatgcttcctttgactttctctactgcagaaactcttctccctgggaatgatttttacagctccagttaattttcatgttcaatgttggaacggagaggaaatggggggagcatgggtggtgactcaggaagctgaggaaatcgcccttattaggcctcgaattttcttctaaaaaaaaacaaaaaacaaaaactggccccaggctgtttgggccttatttttttctgattgctagctttcatttgacctccctccttccatttctttctctctttggttctgctttgaaggtcacaaagcttcccaaagctgttaaaggtggtgctaactccctttactgaaagattactcttcagctgtaccagtggatttcccctaacagcgctcccagaagatgaacagactctcttattgttggtaataactgagtttttaaagaggacaccatcattggcaataatttaaatgacttttctaaggtattttcccaactgtttttctctttttcctcttccacttgagcaaatgtcatgaatttccttttttttaaaccaccaacacaagtattttttttcttaaataatgtgtatacttaaaatttgtaaaatgcaggcaggaaccagaaagataattcattttctagccagtcgtttgttgtaagcctgatatgtgtttgttatttttctacaaaaatggaatcatatggtaggtggtgttttataagaagtttttttttttgttttaattgtggtgaaatacacaacagaaaattgtaaccaattttttttttttttttttgagacggagtttcgcttttgtcgcccaggcaggagtgccatggcagaatctcagctcactgcaacctttgcctcctgggttcaagcaattctcctgcctcagcctcctgagtagctgggattactggtgcgcaccaccatgcctggctaatttctgtagttttagtagagatgggatttcaccatgttggccaggctgatcttgaactcctggcctcaggcgatctgcccgctttggccccccaaagtgctggaattacaggcatgagccaccgtgcccagctgtaaccaatttttaagtgtaatactaagttacttaattttctacaacatcagtaatgtttttcaagttttttaaagttgcagaaccctttcctcaaagaccagagagcttcaagcagagctgcaccaccattgaggcaggagtggggagcccaggctatatcttgtcaatgttgcagtttacggttaccctccccatagctttgaggcctcctagggatcctggtcacactcagtagccaactttgaaagcacatagacctaccttatactgccccaattgttaatagcttagattgctctaattttcttataaagaaaaaattttggacatactttaaatcctctttgaagcacatctgtgattacttccctagataagtccttataagtagagttactgggtttagaatatgagcggtgttgttgtttttttctttttggcctataatccatattgccaactggtcttcaccaaagtgtgccacatcagactctcacagtaatgtaggagaaggctcaaccccccattccctgggtaaaataaaccttaaaaattcagtatgttagcaaaagaaattatcaacagggtaaacagacaacctacagaatgagagaaaatatttgcaaactattcacctgacaaaggtctaatattcagcacgtgtaaggaacttaaatttacaagaaaagccattaaaaagtgggcaaaggacatgaacagacactttttaaaagaagacctgcatgtgaccaacaagaatatgaaaaaaagctcaatatcgttgatcattagggaaatgcatatcaaaaccacagtgaggtaccatctcacaccagtcagaatggctattattaaaaagtaaaaaaaaaaaaaataacatgctggtaaggttacagagaaaagggaacacttatacactcttggtgggaatgtaaattagttcaaccactgtggaaagcagtgtggcaattcctcaaagagctaaaaacagaactaccattcgacccagcagtcccattactgggtatatacccgaaggaatataagtcattctaccataaagacacacgcacaagtatgttcattgccacactcttcacaatagcaaaaacatgaaatcagcctaaatgcccattagtgatagattggataaagaaaatatggtatatatacaccatggaatactatgcagccataaaaaagaatgagatcatgtcttttgtgggaacacggatggagctggaggccattatccttagcagactaacacaggaacagaaaaccaaataccgcatgttctcacttataagtgggagctaaaggatgagaacacatggacacaagggaacagacatgggggcctacttaagggtagagggtggaaggagggagaagagcagaaaaaataactattgagtactaggcttggtacctggatgacgaaataatctgtacaacaaaccctcatgacactagtttacctatataacaaacctgcacttagtgacattattttcgtatgtctgttggccatatatggttcttctttgaactatttattcataacctttgcccatttttagattcagatgtttgtccatgaatccgagagtgagaacccttggttatactgtgtgtagacattttaagcgatattttcaagaatcagctgtgacacaaaaggagtgggggattgtgggccaaaagtcttacagtcagagtttagcatgagaacttggaaagaataaacttctggactttgatctctgattttatgattctgtgatactagatgacttatctgccatttaggaaggttctgtcatattgactagagagaaaatccggagttaaaaccaatggctgcattaagttagattttttttagcagtctgattaatctttactgctccagtactcaaactgcaacgtgagagttcaatcttgtggcttattacaaccacacattgtattaaacatcttctacttgagaaaaacatgaagtgccccatgtgcattttgagtatgttatatcatgagtaaagtcatggctggaaggtagttaagacagaatttctttttgtttgtttggcaagtgatgctaaatcaacaataatattgctttgaaaaggagcaaaattatgccatgactatttgcaatgaaaataaattataaggcctggtgtggtggctcacacctgtaatcccagcactttgggaggccaaactgggtggattgcttgagtccaggagttcaagaccagcctgggcaacttggcgagaccctgtctctacgaaaaaaaaagaaaaagaagaaaaagacaaaaattagccgggcatggtggtgcatgcctgtagtcccagctactcagaaggctgagatgggaggactgcttgagcctgggaggtggaggttgcagtgagctgagatcgagccactgctctgtactctagcctgagtgacagagctagaccctgtctcaaaaaaaaaaaaaaaaaaaaaattataacgcagctgtataataatattgctcaatatgctattataaagtgaaaacctccttctgcttaacaggaggtgtctctatttcaggacaggacactttacatggaataagaacaaagatcttactaatttaaaaaaaaaaacccaaatgtgtgtgtgtgtgtacactgaatttggccagacaggaaaacaagattaaaatgtcagttctgtcttttcaacctgaatgcctccaacagctacattttagaaatttctgaaataattaatgtgtactcatatgttcacccataaatcagaccatgggattactgatgaaaggatgcaaacttgggggtcagtcttggaaaattttgactgaattttaatcttcctattgtgaacatctatttcatgttgaaaactcagcatttcctgtttctcctaaacatagacaccacaataaatagtttgtatctatttcttttccttcaaaaagatcacagttctttgcctgtattatctagctccaagataaattaaatgccagctgaaattgtttggtgtatctaggatgcccatggtatgtgccatttggttgtgtggctgagtcagtggcgttaggtggagtttagcctccccctgagtggttattagggttgtggatggaatgtattgaattcaaatctctcatttataaggcgaggtgtgaattgtagaatgatccgattaacttgggctgaaccccagatattgctgtgtgctttttttcccccttcaacatgtcatggaggcttaaaacagtcacccacacgccctttccatatttaaccttttggaggtgctgtcttattgctgagccagggtggtaatagctgactggcttaaatggacagacagcaacaagatagctgaggagggtaatagatcctgccattctgttcatctgcgtttgtgtctgggtaaaattctcattaagttgcagccagtgtgtgtattttgtgtgtctgtgcattgtgtttgcagtccattagaaaactgatacccatgtggtgccttggtattgacaggtttcctgtgtgtgacctaaaaccattctgcattttcatttgtcaggttttcccgtgtgctctgggttcagagcaaattaacttccaagtcaacagaaccaccgaagttctgcttgaactaaagctaagctactctactggtgtggggggagggaggatgttgatcattagaggacaagggcaagttgagaaattgttctatatttcagccagttaattatcgcagcttcccagcatgtctgcaaggagaaatgagaagaacatcaataagtgattattttctttcattattctgttcacctgccatttactgtgcacgttccaggggaagggagattagcaggggttaactttaaaaaatcagagtcccagaggactcacaaaggcatgctgtgtctgcctttctggtactgagtgatgagggtgggacagggctggtgctaaacttttggatctatttttaagctttcaggacaaattttataaatacgagctgcttctttaaaaaaaaatccctttctactctaaaaatagtttgctgggaaaaagtttgtgaattgtttattaagactcagaaattcagctgagcatgtttccttataaataaagaaaatcacctcacagctactgtcaaaaagcagatgtggcttcttaggaaagaaacaagatttctgggatgttaatgccaatgtcagaatgtgggagaaaatttggaattttccctcctggcttgctcttttcagaccttctaaattctactcatttcttatgatcaagttggtgtcttgtcccttttggaaagagttttcccaggcagaatgaatggccttagcttctgttcttaccagtacccttagccacacctgtctcttttcctataacactttgttttatgttaatgacaattgctaatatttactgtatgccaggcactgttctaagctcagttcatgtgctattttattttgttgtcataactctttgaattagatactactattctcattttaaggataaggactatggtaggcagaataatggcccctcaaaggtgtccacgttctaatcttcagaacctgtgagtgtttaccttacgatgcagatatggttaaggattttggattagaatcacaagggtccttataagagggaagcacatgggcaacaaaagcaaaaatacataaattagacaacatcaaaatgtaaaacttccgtacatcaaaagatacaatcggaccaggcgtggtggctcatgcctgtaatcccagcactttgggaggccgaggcgggtggatcacgaggtaaggaggtcgagaccatggtgaaaccccatctctactaaaaatacaaaaaattagccaggcctggtggcgggcacctgtagtcccagctactcgggaggctgaggcaggagaatggtgtaaactgggaggcggagcttgcggtgagccgagattgtgccactgcactccagcctgggcgacggagcaagactctgtctcaaaaaaaaaaaaaaaaaaaaaaaaaaaaaaaaaaaaaaagatgcaatcaacagactcaaagtgcaatctgaacaatggagaaaatattttcaaatcatatatctgataaggggttaatatccagaatctataaagaactcctacaactcaacaacaaaacaaataacccaattcaaaatgggcaagggacttgaatagacagttttccaaagaagacataccaatgaccaacaagcagatgaaaagatgctcaacatcactgaccatcagggaaatgcaaatcaaaatcacagtgagattgcacctcatacccattaggatggctgctataaaaaaagaaaaaacaacaagtgttggtgaggatgtggaacaattgaaacctttatatactgtcggtggggatgtaaaatggtgtagctaccataaaaaacaatgtggcagttccttgaacaattaaaaatagaattaccatatgatctagcaattttacttctgggtatatatccaaaagaattgaaagcagggtctcagagatattatacacccatgtgcacagtagtattcacagaaggcaaaaggtggaagcaacccaagtgtctatacaacagaatatcattctgcctcaaaagaaggaaattctgacacatgctacaatgcggttgaaccttgatacattatgctaagtgacagaagccagtcacaaaaggacaaatactgtatgacttaacctatatgaggtatctaaagtcaactttacagagacagaaaatggactgctggttgccaggagctggtgggaggggagaaaggagttgtttaatgggtacagagcttctttttcagttttgcaagaggaaaagaaatctgatgatcttttgcacaatgtgactgtacttaacactactgaactgtgtagtttaaacctgttaagatgttaaattttatgtaacgtgtatttaccacaattaaaaaaaattttttttaaaaagggaggcagtaagatcagagttagtgatgatagaagcagaggtcagagagagagcgagcattgaagatgctatactgctggcctcgaagatggaggaagggaatacaagctaaggaatgcaggtaacccctagaggctggaaagggtgggagaacctcctctcctacagcccctgaatgaatgcagcctgccaacacctccattttagcccagtaagacagtttctggatttctaacctccagaactgtgagatactaactttgggttaagtcgccaagtttttggtaatctgttagagcagtggtaagaaactattactaaggactattcagttcagagaggttaggaccttgtgcatggtcacgaagtgactggaactctgattaagagctggagctggccaggcaggatggctcacacctgtaatcccagcactttggaaggccaaggtgggcggatcacttgaggtcaggagttggagaccagcctggccaacatggtgaaaccccgtctctacttaaaaaaaaaaaaaaaaaaaaaaaaaaaagaactgcaaaaattagctgggcatggtggcacagcctgtagttccagctattcaggaggctgaggcagaagaatcgcttgaacccgggaggcagaggttgctgtgagccaagatcgcaccactgcactccagcctggcaacagagcaagactcagtctaaaaaaaaaaaaaagagttggagcgcatgtccactccactcagagttccagccttcctagatggtgagaccctaggtagcagtggccatctttaacactacccccgacataggacttgatatatattaaggcacttagtaattgtggctaaaagatttaatgataatgcaccatcgccttttattctgttcccctgatgctgtgtcctagaagccatagggttaaacctaggaaaaggctttttagaaaacgtttcccttccctgtcattgtggggctgctaaggaatagtgtcctcaaggttttagtgtcacttctgggggcctctgggtatttgttgccaggtcccatgatggagtagagtcaggagtgcttatagaatccagacaggggtcagagtcaggggaaatttggatcctgttcttggtagatgggcagtctgttttgagaagaaatgaccaaatttagtcatgacctgttaacctgtttattaacattatttctctttaagctaaataaacgcagatatttctaagcacaaatgaagaaatttctgtgttagctctgatcagtgggcatttcccactctgaaatgcttcctcacccccaaacctaagctttggaaaccaggctcctaaaatcagggccttgtaattccccatgtgagttattctaaattgggcttctgggtgtttctttttttgaagtggggagcaggtgggaaatgagaggccttctaataatgtgcattaacttttgccataaaattattagaaaaaatgggtattttgtactttttttttttttttttttttgagacagagtcttgctctgtcacccaggctggaatgcagtgggcaattgtagttcactgcaacctccacctcctgggctcaggtggtcctcctgcctcctgagtagctaggactacaggtgcatgccactgtgtccagctagtttttgtgttttttgtgtagacggggtttcaccatgttacccaggctggtctcgaactccgtacctcaagagatctgcccaccttggcctcccaaagtgctgggattacaggcatgagccaccgtgcccggcctactttgtacttttaaaataatctttgagtgggaaggcctttgcaatcatgtcacaaatctgaaagacctaagggaaaagattgattgattttactacatagaaattagagacttctgtatggacagagatagaattaatagaataaacagacaaatgacaaacaggtaaattctgcaacacatatgacagccccaggggcacttcttttatatacagagagctattagaaatgagagggaaaagcaggatgctatgtaggagaattgacaaaagacatgagtaagctcatcacagaaaaagacaagtggataacggtaagcatatggaaagctgttcaaccttattttttactaattaaagaaatgcaaattaaatatcatctcctgttatcagattggcaaaaatgaagacatttaaaaatagtatggggaaatcagctctcttccatgctattggtgggagtgtaattgataaattttttggaggccagttttttattatctgctaaaagtaaggatgcaccaagttgttgacccagaaatttcactctagggaatttgtccctcagttgcctttgtggtatatgtgcagagttatgggcacagtgatgctcaatgtagtgttgtttgtaatcgcagaggacttgagacaactgggtggtttcatgtgggttatagttctgtgagaagagaactatctcctacccagcaagattcaaataagttacccgtttaaccagccaaggatacagaaatttagaaaggagattgcctcaggcaggagcgtatgaggtatatataaaaggtatatcccagataccaatctccactcgcaggtttccagtggtctaaatggcaagggagattttgccagatctcagaaacagccaaagtttgctgtgccacaaatcttttttccatgagcatttcagaagagccaatgaggacaactgttgtgccttcatctgtggtatggtgacaaataacgcagctcacctgattcaccttgcctgctgcctagacagagccgatttatcaagacaggggaattgcagtggagaaagagtaattcctgcagagctggctgtgtgggagaccagagttttattattactcaaggaattggaatttttaaagataatttggcaggtagggcttgggaagtgggtagtgctgattcaggtcaggttggagatggaatcatagtgggggtcaaagttaggtttccttgctatcttatgttcctgggtgggatcgcacaactggttgagccagtttaccagtctggatggtgtcagctgatctagtagagggtctgcaaaatacctcaagcactgatcttaggttttacagtagtgatgttatccccaggagcaatttggggaggttcagactcttgccaggagctgcatgacccctaaactgtaatttctaatcttgcagctaatttcttagccctccaaaggcatactggtccccaggcaagaagagggtcttttctggaaagggctattatcaattttgttttacagtcaaaccgtaaactaaattcttttccaaggttagttcggcctacgcccaggaacgaacagggacagcttaaaggttagaagcaagatggagtcggttaggtctgatctctttcattgtcataatttcctcagttttaattttcgcaaaggcagtttcacttccgtgttccaaaatctactttcagacacaaccagactgtcccttttgatactggtctatcctacagttggattctgtgcagctatgaggaagaggggcaaagctctgatggagaagttgtctaagatgcattgttaagttgaagaaagcaagttgcagtatagcacacatagtaagagtccatttgtgtcctcttgttatgtattttttggaatgaacatgtatacctttaattattaatttttgagtggttacccacacacagttttgaaagtcatatgctgctaaaagatgtgtgagtacccagcagcctcttgtcccttctctttgtgtccttatattctaggaggcagtcgttcttcagttctagctgttgcttctactatttgctgctgtgcttctgaataatattcattgctgctctcttggtttgtcgattctagatatgatctcttaactatcatggtagttgaggacttcagcttttctctatatgcacatatctcaggttttgctttaatctatacttaatgttttcattaatgtagcaatgttgatattgaatattgaagcaagaatatactataattaacttacgtatatagctttatttctctctctccctcctttcctccctctctccccatctccctctctccctctctctcccccctccctccccactctctcccttctctctctatccctctctctctctgtccttccttcctcttcgtccctccctctctctctttctctctcccctacttcctctcttctctctctctctccctccctctctcaccaccatctccctctccctccctctctctcttccccccctccctcctccttgttttcttctcccccctcccctcccccctctctacctctctccttctccctctcctggaaaaacaccagagccttccaacctcctgttccactctgctgcccagctgtcagccaggaaattcccatcacacctccgccgcctcctctctctcattgactgtcctggatcttgcgtccttctctttcttgttttactcatttgacttgatggaatgcaccctccagtagccttctgagggagccagtgcacggcttcaagtaaattttttgaaacttcttcaaaaccaaccacactaggagttgcatactaaaaagtttttccttttagcattcaaccatcccttcttagcccctggcccatgtctgttggcaggtggggttctccctcctactgatggagccagagaatcctgggacccagaggctgtgccattattcacaagatcttatttaatcttcagaatggtttgataaactaacaaaactgaggcaccaaggttacgctctcagtggtatcagaaccaggaattgaagtgtcagctgcttgggccaggctgatgcctttcctaatctagctgctccttactggaagaaggaataacagtaccatgccccaagtgacacatgccagatgcatgtaaccatggttacagggtgagtccaattctcggtgcccacttgtgtctggttcctgacaacttcagctctagatagccatccttctctctagaagtaccttccagtatgtatgtatgtatgtatgtatgtatgtatgtatgtatgtatgtatgtatttatttattttgagacagaatctcactctgttgcccaggctggagtgcagtggtgcgatctcagctcactgcaagctctgtctcccgtgttcatgccattcttctgcctcagcctcccgagtagctggaactacaggcgcctgccaccgcgcctggcttattttttgtatttttagtagagacaaggtttcactgtgttagccaggatagtctcaatctcctgaccttgtgatccacctgcctcggcctcccaaagtgctgggattacagatgtgagccaccgcgcccagccaagtgtgtgtgtgtgtgtgtcgagagagagagagagagagagagagagagagagagagagagagggagagagagagagagaggagagagagagagaccgagactgatttatagttatggtcctagctccttatggtaattaaaatgccctgcctatgatttgtgtaaacttggtgtgattatttttattgctacagtatttggttttaagcaatgtaagaatgtcacccccctcctcccattccttttgtgatgtgaaatgcttcattacttaggaatttgctgctgattgtacagtttagcatttgatctttttgttaaccacagtcaggtgaccacacatagggtaattagattaacccacccctcctcttctccactgaaacaatgtaaaatccaatattctattagcacatgccttccgtagattaatgatcttggagttgctgcgtggaaatttgcatagctccctacagctctaagaaatgaaaatgcccagctgtctaaaagctttaatcaggaaatgagcatgaaatggcattgttttgtcacgggcttggaataatttattcttgacaatcgagttatcctggatataaatgtgtataaacattctttcaacaaccagtaaacaggtgcttttttgttcgttaaaaagtcaagattttcttgacttgggcttggctttgaaatcgttggccctcgtgctggtcactgccaaaagtttatactaaagtcattttccttgtccctcctgttttaaatggcagtttctggaggctggcctttcagagcaagaacggtcttagggagtgaaggaatggggacatggccataggaccacacggggtcattcctcacccagccccttcttgcctgtgttttcatcccctcttgggacctactttcccctatctgtcaaatacaaataataatggcccctatctcttaatgtggttgtgagcattaaatgtgttatcccatgtaaagccttagaaaagtaccttgttcatggtatattcttcataatggcgagctaattccataagacatagggaaatgaagatgcaattctgtttctttttctatttaaaatatcctagtgcacttaaatttttttctgttagactattagtcttggaagcaattgtgactataaatgctttcatttatgttggcacaccgttaaaagaatgatagaactaatgataatggctaacattcattgaatgcctgggagtgaaagactgaatgaggcctattcctgactcttggggctagacataaggacccatgcttatagcccaggggtgtgtgacaggctcttactcatcatcaaagctgttaaaaagacagcagaaacggcccttggaccttggatgttgcttcctctttttttctcctccaagagcaagctttttatctagcacgtgatttaacagttcctgtgttgggggtactgtttcatggactaggtatgatgtagtgagaaacattttaaaatttttccagaggagactttgatgggaaaaatgcccatccctcaggggactcaatttgagatcgtgtaattaaccttttggagcataattagccaaactgtttagctctttttacttgtactctgggcaccaaagaaagctggatcctacccatgataaaactatcatcaataagatttaatgttgcctctttatatgcattttatttttcttgattgtcatgcccttagttattcttgcatttcaagaatctttttttttttttttttttttttttgaaacgaagtctcactctgtggcccaggccggagttcagtggtgcgatatcagttcactgcaacctccgcttccagggttcaagcgattctcctgcctcagcctcccgagtagctgggattacaggcacgtgccaccacacctggctactttttttgtatttttagtagaggcggagtttcaccatgttggccaggctggtctcgaactcctgccctcaggtgatccgcccaccttggcctctcagagtgctgggattacaggtgtgagccactgcccccggccttgaatcttgaactttatatcacatgactgaaaaaaaaacattgattattgggttttgcctgattttccccacatcttagctttcctgtctcccctgcttaatgaaacgtatggactggagagctttctgtaaatcttttgtgtatgttagcatacactgttggatctttaaaatcagtagtggaaattatatagctaaactcttattggggggcagtgtcaacttcttccttgtgtcaatcaagaaaaatgatgagacaagtctcaatcattttaggaagtttatttgccaaagttaaggacgcacgcccgggagacaggtgctatgcctttctctgaagatgattttgagggctccaaatttaaaggcgaaagggtgggatattgagaagtatacaattttcacataagaggcgggtagggaaaaatagttattcatgtctttgtctggctcggtgaatctgcttttttttttttttttgacataagataatatagacaaatggggcagaggaaaaatgcagggaatctgtgtttttacataagataacatagacaaaatggggcaggagaacagtcagatatgcatttgtgtctggtgagcaggggacaactgcacctgtaaagataagctatcaatttacattgccatggtgaaatcttaagagaaacaccttagggtaaagaccttggagctcactaggaatttccttgtgggtaaaatatggggtaggcatgtagtttttcatcttgtagccattgtattcaggaaccaaaaggggaggcaggtttgcgtgacccagttcccagcttgactttttcctttagcttagtgattttgggaccccaggatttattttccgttcacacttgtttgcaaaaaaaaaaaaaaaaaaaagcagtcaataatttaacgatcaggaaatagtaaacatatttcaattactcaatgtttaagttaattaaaattttgaatagctaacacaggcatatggtgccagctaaaagggacaaaatatatgctttctctgtccctcggccacctggttcccctccctggaggcagcctcagttatcagtttattgtgtgtggcttctgtattacacacagaggcgtacatacaaatgtacacaaatgctagcatacgttaggctttttttttttttttttaacctagcaacatgtcttggtgattgtctttcttggtacatacagactgacttcagtcttggagagagttgcatgggattgatttatggccattcatcagctgctctctactgatacacatttatgttctttcagtcttttgctaatttaagcaatggcataacgattaatcttgtacatatgctgttttgcacgtgtatatttgtagtttaaattcctaggagtagaaatactgagtcaaaaggcacagacatttaaatttttgatagacagttgtcaagttgcttcccacagaggctgtacaaatttatttatcaatttatactctacttagaaagtatgtgaggctctctttccctacacccttgctgacattatcaatttttttaattgttgacaatctgacagataaaaatatctcattgtaatttaaaaattaggtacatccctccctaaactgtcaaattctggagagatttgttcttggggtcctcatagcccccattctttgagaggaccagctgtgtgccaggcactacgtcacatgctgtgaaaacaaacagtattctgagagagccagattctagtgcgaggacacatgtaaacattattataatatagtatgtaatatatactatagtataatatagtatgtaaatgctacaattctaggtatgagaaaatagccggaatgatacagggtccttctgtgtactgagcactgtcaggcactgttgtacaggaataccactgtaattttcatttctcttgttgtaccaggacaagccgcagacaaaactcctcagacaccgagttaaagaaggaagtggtttattcggccaggagcatcggcaagactcctgtctcaagagccgagctccctgagtgagcaatttctgtcccttttaagggctcacaactctaagggggtctgcgtgagagggtcatgatcgatttgagcaagcagggggtacgtgactggggactgcatgcagcggtaatcagaacgaaacagaacaggacagggatttttacaatgcctttttatacaatgtctggaatctatagataacataaccggttaggtcaggggttgatctttaactaccaggcttaggtcaggcaggcccaggcctagtttcaggtctggttcctaggcgccaggctacctgcctttagtttcgcttctctttctttttctgagtataaaacagtataaaacaatatgagacgttctgtctctcttctctcatcgtgaatgcagttaagcatcttgttgcatgtttgagtcatttttttcttttttatgtgacctgtcctttgctatttttttgttgggttattgatcttttgctgatactttgtagaaggagctctctttatagaagaggcaacattcccccagtttgtcttttgtcttcgttgatgaattttgtcgttgttgttgtttgctatgttatattcttagttttctgtaatttatttttatttatttatttattttgagacagagtctcgccctgtcgcccaggctggagtccgatggcgcaatcttggctcattgcaacctccgcctcctgggttcaagcgatgctcctgcctctgcctcctaagtagctgggattacaggcacacgccaccacaccctgataattttttgtatctttagtagaggcagggtttcaccatgttggccaggctggtctcaaactcctgacctcgtgatccgcctgcctggcctcccaaagtgctgggattacagacgtgagccaccgtgcctgccattctgtaatttattgaccctttcttttctagcttctaaattctgtgtcagagtgttaaattatctttgcctttctgagattgtagaaacattctttattttcttctagtgctttaaaggtttagtttttaaatgagtaaattcattttgaatgtctaatattcccagttaaataaagaaataagtattacttgtttttttaaaaaagttagggactacatgaattttcttactgtatcatcttctcccctctgctcctaagcctgatctgcatcttttaaggtgagaagttgatggtgatccagccgtatctttatagggatgatacagatctccatgttgttgcagctttgggctcaattgagaatattctgcctctgatcacttgaggtcaggaattcgagaccagcctggtcaacatggtgaaactgggtctttactaaaaatacaaaaattagctggatgttggtggtgggtgcctgtaatcccagctactaggcagactgagacaggagaatcgcttgaacccaagaggcagaggttatgacagagcaagactcctccctacgccccaccaaaagaaagaaaatactctacttcatctgtagacagccatcttgcccataacactctactaaattggtcattcatctgatagatatttttaagtatccaaacaactggttgatattgacaccctttgatccagtggtaataatctagatgtttagcggggtgtgggcaaacataaaggcaccaactgtcatgcaagtaattacactgtacatcgggaagcaacattatctctttgggacacaaaggtagtcgttctcatttttgtccagtatctgttacttgttgtggtctttatagtgttcatccctttcctgaaggtcaagagcttcttgcccttgttctcatgttcttgttattttcttattcgtgttatgagtgattcttgggagataatactgcaagtatatgatattgcaaatatgcagttaaagattgacatagaacatggtaatagacctgttacatttcttgaaatttccttgttagctttgagctgaaaataccatcagaatatttatgagtatatatcaaagcacttttctgagcatcagcatattttgtaagtatgagaaagccattgtggtgtgagacatcaacgtggttctgctatgtaattttagggcaaattatgaaatatgtaaagcatataacaaatacctatgtgcccatcacccttgctttattaaatcctcatattttgccatatttactttatgttttttttcttctttacagttctaatgaagttggtgcacttggtggtttgatagcatgggtattttcttttattgtggtaatcagatatattttttaaagaaacagaatcttaaagctacagctgaagctccccttggtagtctgccatattctcagaatacttgctgtgtcttcccaggtgttctgagacagaccagccttttgtgaagagagccaaatactgggaaggcacagtctctgcacgaagggaacatactcacggggcagctgttcctcagacttgccttttgcgtggggtggggtggggtcaggggagagatatgcatgttggggaacaatgtgctattctaggtttctgtgtctattcaaagctgtcttgatcagtagacttggtaaaagtgtttgtttttagtgatttttaaaaatctcctgccagtggtaattttgcaaaatggttttctatgaactagtgcagggggcacagctgtgatcctgcagccacgtctgggtctaaaggaagcctttcctgcagaaagcaatagagcaggactgagggcaggctgatgaatgatgtctgtttcccctgccctgcttccaccctaagccaagggggctctgcccaacctcactcagctcttcaaatgcagagagaagtaccaggaccagcattctgggcagatcagggtggtgcccagctttccctggtgtccgtggcaccagcctgctctgtgtgccaatactgttggtgacaggagagagagaaatctggcaagatagggggaaaacagctgaggtggagaacaaggatgccctcttgggaacagatccattcatctgattgggtaggtgagatgagacacgcatggctcacctactccatagggtgcatctggcacattccgaccacctgccccattgatgttgatcccagaaaacatctcaccacctgagatgaacattaaaatacccaagcactagctttgtgtatgtctgacctcctaggagaaaatatcagcacatttcaatttaaaagaatctgtcttctttcagtttaagcatttgtgctgttcttttaaattgaaattgcatgcagtgaagtgcagaggtcttagaagtacagttcaatgaatattttggtctatgtacacctgtgtaaccaccacccagacctcgttataggacattttcatcctcccaggagactccctggtacacctccccaagtgtaactgctgttctgagatctctcaccaatgattaattttgcctgttgttgggtttcacataattggaatcatacagtacatcatcttttatgtctggcttctgtcattcaacattatgactgtgaatttcatctgtgttatgtatagttctttttaaaatagtatttgctatttaataatgagagtagataatcaatttgtatactactctctaattcactctttgatcctgaagacacctctcggatggtgtgtttgttgttagacctcttttacagatgacagaagggctgcatagagactttaagtgttgcccccaaggtcacacctcagataaatgatgacgtcagtactagttctggttttctgatgcacagcatcattctccattcatcgtgaagcctgtgccttaaactgtgttatgaatggtgaaagaagtaaaggatgaaaggagggaggggcccccaaactgatcatattttggtattttactgtgtagtattttggttacagactgaccagttaatttaaaggagttaacactgaacccagccaactcaccagtacctgtaaagtatgaaacggatggtgagggagaagagaaaagaggtagccaacttggctcagcagccagccagatccaggcaacgcagcttatcagaaagcagaccatcctagcatagctcgcagttgcatgcacatcatctgtttgcccggtgaggctgctgtttgcaggccgctgaatgtgtcgtgaatttttgccagagtggcattattctggctttttggtctctgaatgtgggtgagccatcccaggctctgtttggtacagtgcttttgggaagggaatggtgtgagttctcttccttttctcaagtggtccttgtgacacagctgaagcgtcctttgcagcattgataccttattgatggcctcggttttattgtacatgctgagtttccattgtaaagagatcagatctgagataaagagaagctgggtttcctttgctttctgaagaggtttgctgataccctgtctgttctatattgtctttaagcaagcaaaatcattgctgatttatatatgtgggcagttatgtatgcatttccatgagccctcatggcctgtaattctggtccagggtgtggcctctactactgagattataggacccaggttcttaacaaatggcaaaaaaacacgggcctgatggtcagaaagttgcaattaaagacgggggtctaggaacccccagtcccaggaaatccagagtcccatgacctggatcagaacctcggagagctccaggtacttggctgttggcagatatacagaggcaggagttgctctagttccaagccaaccctcctctgcaggaaggagctcttctatgtggatggataataagggacttcaaagatttgggcctcaatagtcttgggctttataggtaaggtgatctgttacatcacttaactgtggagggaagctaaggtttccactggagccacaggctgagtggttttgagtctccctcctatagtcatgccactggttcttcttaggaggtgagatgtactaggagagctctgcctagaaggctcagagtttggtttcatggccagctctgccccttgctagctttgtggccttcatctgatcttgcatcttctctgactgggtctcactattcttatgtataaaaatatatgtttggcaaaatcagttgtttttttttttcctgacagtgttgttgttaggaacaagtgaaaaaatagctgctaaagcactttaatttataagcctttgccagtgtacagttgtatcattgctagcatcatcacctatttttagagcctgtggataggaatccatgacgtcaggattctgtgaacataaggtgttgtccaagcagtgcaccatcccccaacttatatttgcatggtaattggttctgtggggtcagcatgcatgtcacatatttttagtcagaagcaagtacacagagacttgtggtttgctgttcaatttgaaaagtgtttgaatgaaagcttgtcctgtggtcttttggaagtaactggagatttctgtagggactgacaagaacaacagacgtttgagtgtccattttgcagaggctaaactgggaggggagagattgtaggcaggaagacatgattataatccaggcagtactccaggaaacagtggttaagagatgagctctcgcctgtaatcccagcattttgggaggccaaggtgggcggattacttgaggtcaggagcttgagaccagtctggccaacatggcgaaactctgcctctactaaaaaacacaaaaattagccgggtgaggtggcacgtgcctgtaatcccagctattcgggaggctgagacatgaccattgcctgaacccggaagtggaggttgcagtgaactgagatcacgccattgtactccagcctgggcaacagagtgagactgtctcaaaagaaaaaaaaaatgagagagatgagctctgaagctagacaggttgagttccaatcctggctcctacttgtctgaccttgagcaagtttgcttagccccctgggtcttgtgtgggtgtctgagtagggccatagtgtagattaaaagttgcagtccaggtgaagctcttagagcggggtttggcacatggtaagcactcagatgttagctgctattcatgtgggagtcttctattcattttattgtggtaatatatgtaacataaaatttaccattttagttattttaagtgtacagtcagtagcattaattacattagaatgttgtgcaactatccgtactatctatgtccaaaacattttcactactcctgagagaaccctttaactatcaaacagtaacttcccattctgcctctcccaacctttcaggtaacctctaatctactttctatctctatgaatttgcctattctagatatttcacataggtggactcatacaatgtttatccctttgtgtgttttatttcacttagcataatgttttccaggttcatccatgttgtagcatgtatcagaactttattccttttcgaggctgtataatattccattttgtggatataccatatcttgtttatccattcatctcttaatggacacttgggttatttccttcttttggctattatgtataaagttgcagtaaacactggcatacaagtttgccttgggggcaaagctttcaattctgctggggtccctgctttcaatgcttttgagtatatacctagaagtggaattgctggatcagatggtaattctatatttaactttctaaggagctgccatactgttttccacaggagctgccctattttacattcccattagcaatatacaaagattccagtttctccacatcctcatcaacacttgttttcttttaaaattctagccatcctagtaggtacgaaagggtatttcattgtggttttcatttgcatttccctaatgactaatgatgttgaacatcgtgtcacatgctcattagccacttgtatgttttctttggagaaacgtctattcaagtcctttgcttggcatttatatttttttccctttatgtttttaagatactacaggaggacaaaaaagaaacagattgagaaagtagatgcagccagactgggcgactgcttagatagggggataatactgaattttctactctgggtaattgggtggatgatggggtaccaaagaagacaggctgccctttcctgggagaaggggcaggttggagaaaaggtattggctttgggtggggctgcattgagcttgggtgttatccaggtggggagcctatagaattaactgccacggccatgtgtccgattggtttctctgaaaaaaatgcaagacatattttaggttttgtctcctccctgcttccacctaaagaagcaacttaagcaattcactcatcattcagcttctctatttggcaaatgtgaacaattactgggggaacaatggagtctggaatttatgggccagcctctctcctggtgccagtttctcagcccttcagcacctgctcttgatcagacccagtccttcctagccagctgctccccacgtgctgctctgaagcattggggagtaggggtgagccttcttgagaaccatggcttctgaggctttctccagggaccaccccagcctcacaatgctggcgctgcttctcccacccttccccggctgcatgccattagcagttattgctaagtagacacttgctatgtcgtcctcaacccactgactttctctgagttactccttggcaaagttgggtgttgtgctctgttgtgttactgcatcacgttgtgtctaggtggggaatttgcacgtgcacagtcatacccacactgcgatggaaaatgaggtttgagcaactgttcttcccccaaagaagcaaccggtgaggaaatgagcccacttggtggcttgttgtctttactttcagagccagagcaggctggcagccatcaccaagttagcatcctgtcatgtggctcaggcgggcaatgtttgcagattgtcccctgatgccatctgcctgtgaggctacaggaacccccagcaactgctgctctagcaggtgctggggctgctgaggtaggtgtccgtgtacatatattcaagcacacacagctttgtgtggtgtgcagaggtaccggtgttgggctagggctgagcttcgcctagttaggcctctgggacgccagttgaaacactcaacctagcaaagcgccagccccagttgttggtttccggtggggccctggtgagggaggaagagagggtgaggctgctgtgaacagaggcagcaactggggaattggatatggtaactaacacactcttgagtgtgcaggaagctgcggggagtggcattgttttgacaaacttttgttgctttctttctgcctctgccctctgctcgggcctagtcatggccctctacccaatttagcatctctgttccttccagcggggagcccatccccatttcttacctcatgggctctttttaaggagcgcattcctcatctttgagctcttcctgccattcagccatgctttgggtcagcccctaagctttcacttttccccaagttactgtgattatggattcagacaagcctagaaaatccttactcctttggggggaattcctgtatacagacttatactttgtgagtcactattatcttggtctaataatgctttttaaaacaattatgtaaattattaaagcaatttgaaataattatattagccatcagatttcagaaatctagatcttaatggagctttgattaagagtctacctagagcaggggtcagcgaactttttctgtaaagggccagatattttagactttgatctctgttgcagctactcagttccgctggtgtagcatgaaagcagctgtacaaaatacttaaatgcatgagtatagttgtgttctaatgagactttctttacaaaagtgagtggtgagctttcatttgctgacccctgatctagagtgataagccatccttattttttttctttgtcaagagttgaaaagccagaggaacttgatgactgtaaatgcattagaatcatcttcttttgggtttagtatccttgtgagcacaatggtaatttgggaatatgcttctttaaatctctgttgagaagaagataaatcagaaggctttttaagggggtgagtctgcttggccaaagcttgtcattgtttaacaagaacaggctgtcacttagagctgtatggtggcttttatgtttcactcattctctttatagtcacatggaatggccatagttacataaggtcgcctcaccatactggggcttattccactttataggaccaggtgcttttctaataaatgtaagaaaactacaaagatacagaaaatggtgtttttaaaacatgatgttatgctaagttggcattgctatagttcatttccagaaagatggagcttaagatagtccaagaggcattctaaagtttcaaactataatcttgttttccttttatctgtcctcacaggaaataaagaaagagatgaagaaagaccctctcaccaacaaagctccagaaaagcccctgcacgaagtgcccagtggaaactctttgctgtcttctgaaacgattttaagaaccaataagagaggtatggaaaaggaaaaagaggttccctccctgcacacaaacaaaagctggaaacttctggtgaactgtgtcaaactttatattgctgaaaaattgaatagagtttgtccttttggtttttggtatatattttggatacacacatacatacttggcaagtgactatatgtatagtaactgtaataaagggaactaataaaaatattttttgacagtgggaaagtagactacatttgtaaatgatgatttttctggagctgtagatttcactttcatatctatttttatggatgaaaggtgaatttagagaatgctgtggtgcaggcctgagccgtgtgtctgaccgcactctccctttaatttaaggcaaaccttatcaagttatttctctctccaactgctaggctccctagcgcagaccctgcctctctgagtttgtgaggcagaatgtgcaaagatatagctaacacatctgtctgaccagaagacctttaacaatcttgttttctctcttttgagacctcaaggcagattttcaggtatcagcttgttggagttttgttttttctcccatcccctcttggtgataattgtttgaaataatgtgagagagaatagaagactgcagagacgaccccactcaattttatactgtgagcacactagggtccctccgtttttcctgaccttggaccagccagggcacatgctgagcatgcctgtaggttagcgcttggctgccagcttttagtgggcttattacttccttaaagagaaatagagagctgtttgaaagcaggcacaggaactagattagcaaagggttccattaaccagaaaaaaagaaggcaagtttatataaccatggggaggaagaacagctaatctttcataaaatttagacaggataagaatttgtccagtaaactgcccattgatcatagctttgtgcctctcttcctttctgtctcttcctctactgcctccagctgccctgggttacatttccctttttgaattattcagatcaaatattggctggaggcccatgttggttagcagctataggattttctttcttttctcgttttgttaaattcatcctaccaaagcaggggatttcccattttaagaattaagtgccctttgctgtaaaactacagtcttgcccaaaagtgcctcctgcattcttgcaagtaagctctcaaactcctgagacctgcattcattggatttggtgaggtagagttcagtgtgtgttctttctgcactttcaaaccaatgagaaggagccctcccattcctccacctgcctcttgggtccgcgggcacggcaattgcacgcatgttgaccagcggcaaggcctctttggccagccatggtttttgtcaagtcagtaagagatttaaagtaattaattaatttaacaagataaggaattaattaaggtaaggaattgaggtaactatttggatgagtttagtaaaattacctgagaactttaaatcaacgaaggaatagaatttttcagatgattatctcttcaccactgaaaatctggcctctgagttcccctatggaatttttcattcaccaaaaattggaatgcagagggatggcttactgccttacattccattttgaaagctttctgccttggacctgcagcctggttatggccaacctttcattctgaggcattttatatgtggaatctgccggtggttgtgggacctgagtacatggaggcattctgtaaatatgaagtctataacaaatcatcttcattctgtccgaggcttcaccctgacctcctgggtcacctgggcgtaacataaatttccagctgaagggaagcattgtgtaccaggcccagggctgcctctggccctcccccaccagtcaagactaccagtattctgctaccccttataataaacagcgggggtagattgattggccttgtcaggccagataaatagttcattgtactgagctcaaaagctacatttttttcccacccaaaatcaatgaaaaaaacacttttttccccccttaaaacaaggatcagaggctaaatctgtgggatgattctagttacttgtaaacacttcggtccaactaatttttaaagttttatgagttaccataagtgactgaaggggcctccttcccctttgtttccatcatcgagctttgtctccagcaacctttcggatgttttggtctattactgttgttgtggctattagggaaggaagttgctttcaggatttattaacagcctgctttgattggctaacatgggatcttagaggatatgagttgagtccaccttgtgattcagtcttggacccttgtaagaatttaatagaatgaacacaagttctcttccttgaacttgatcaaagatgagatgactgttttctgtatatggaccttatcatttgatacatgcttgaagttggattaataatgaaagattgacatctatttctatcatgagtctgaaactgaaccacttcattgggtcctgaacttgagatagtcctagctgaagaagtttgcccaattgtgtccagctgtttttgcgtcttgtgacatgcctcactttgcagcaactgcaaacaggtagtagtccctcacgttgtgggatgagctcaccctccccagacacctgcataaggtcagaagacatcttgggtttgaaggaagctattcatagccttgagaaaaagccagggctatggaaaccttagtttggggactgattagtttcacttttcagctttaacgtttgtaaacgtctgcagagttgatttagggggtactggaatgactccatgggctttttttttctttctttctttctttcttttttattttttggaaacagggtctcactctgacacccaggctctcactctgacatccaggctggagtgcagtggcgcgatcatggctcactgcagcctcgacctccccaggctcaggtgatcctcccacctcagcctcctgagtagctgggactacaaggtacgagctaccacacctggctaatttactgatttttcgtagagctggggttttgccatgttgcctagctagtcttgaacgcctgggctcaagcaagcctcctaccccagcctcccagagcactgggattacaggtataagccactgtgactggctggcttttcatttgagaagatgatgtgactggaattgagagagagaaagtacatcctcccagctgacttggcagccactggctacacattctggcattagaaccttaggggcacttgtgtctgcactcacttctggccatttctgtggtccttacctgagtcacagtgaaagagcttcctgtttaaaacaagcctttcctgaggaataagaagtcgtttttcatttaaacttgcagcatggatgttgtatgttctgaagttatcccagactccagtatatcgatgagttaagccagaaaatgtgaaaactttacttggagccaaatgtcattctcttgatgaaccagacagaaaagagttgtatgttttcttcaaagaatgattgattcttttgtttcttctatcattaaacccataaaagagaatgatgggccctcctaaattggagcattgatatatagagacttttttaaaaaagcattcaaatgccgagattgtgccactccagcctgggcaacaagagtgaaactccatctcaaaaaacaaacaaacaaacaaacaaaaaaaacgcattcaaatgttgagtttagaagaaaaattgaataaaacggaagtttgaacagttagcatatatcctaaataggttcttgaaaatgaacagtggatttttgtccatttgaatatagactcttacctacttgaattaaaaatgaaataaaaaaatcaagctggacacagtgactcattcctgtaatcccagcactctggaaggctgaggtgagaggattgcttgagtccaggagctcaagaccagcctgggcaacatagcaagaccccatctctaaaaaaaataaaacaattagctgggtgtggtggcatgcacctgtagtcttagctactcaagaggctgaggtgggagaatcacttaagcccagaaggtcggggctgcagtgagctgtgatagcgccactgcactccagcctgggtgccagagtgagaccctatctcaaaacaaaaaacaaaaaaaagaaaaaattatttgatccttagaaggatttcctggctaactttattcatgtgatcagttaagtatccaggctgtcatcaataccctgctggcccgtgtgaggaccaggttccatctcagggttctcgtttgcactgttaacagtgcatgcagagaagatgtatctctgcctctctctgaacctctcctgttgcctggaattttggacattgttccttcctcactttttggtagacacccatgaacattcaatagtacatgtttagtgcatgcccactatgcatctgcccttgtgcttggtgatggggcagataaagactggaaaaacaccagccagtcctgcctgcaagtaactcagtctgttgtatcccttgggaaacgttgagaaagtgctgcacgtttcttatatcattttgatggcaaggtggggatgtgtcttgtatttacttctgtcattctgaatgtgaagccactccgtgggtttctggttggctttatatgtccttgtttctatttccagtttatcatgaattcagtgtttggtaagtctctattgtattttgcacatttactattttttgctatattattatgctctcctgatacaaaatgtattttatagttacctttttaagtcgctctgctactttggcatctgccttcccaaagataaactgcttttaccatctttatttaaggttttttatgcatttgcattttactgccccttccagagattaatgctgaaagatctgacggtttaaaagatgttatttgtaacaggtctagctctgatgctacgaggtgagatcgtctgtctcatgagattcaagttaagatgggggagggttgctctctgaattgatatgtgggtatgactgattgtagaacattgctctgtgggttcatttctggtgtgtttaatccttcagacgggttccattcaaaagttttccttaacagagggatcaacggctgctcttcctctggtgacacactgttgctttaaaagttagtgcagaagttcttccacattaatatggacctcgtgtttgccacatggaagggctctccagtttggtctgctacctgtagctgtcagaagaatgttgcttaatgtttacctttcttctcatagtttcagcactggtcattccaagccctaaacagatctaagtgactgcccgtcctttccccacttcccctgaaggggaaacgttttttctagcttttagtgtgagggcctggaatgcttctcatggcgccaaggcggtggcgtggatcttgataggccgtgagctctttggcagaaatgaaactgttaacaaaggatggaaagaagtatgtccttagtaaagaaaatgtcaacctctttggtttgccagtggtttgttgtttaaggtaaatgtgagatctgggggtttgtttgtagagatgagactttgtttctttcaaattttctattggagaaataaatgtgaattcttgccagttaactgggaatctgaaaatgtgccatttggggtcagacttttctttgagtttcaagattgcctgtttatttgacttaaggagctggtgtttatggacagatagaataagagttaacagaagacattactgttgtgtagaagctcttggctatcacctgagctggtctttcccaggggaaatgaaaatctggcgatctggcagtgaatggggatagatatgatacatagtcattcagtaatatatacgtctgtgtgaatgtatctgtatacgcatctatagtcttattttccagtgggccttcattctcaaaagctctggagtcaagagcctttaaagaagtcttttaaactaactgatccctgactgcatttctggcaagttttattgggacactgcgttgttagcaccagcaattgatgttggagtgtgtgttaccctttttcatgttattttctgaacctattgagcctagagtgaggggtggtgaaatgcatggtaagaactacataggagggtatagccatcatgttgcgattatgtgtgggtcattgataaaatcggtttttagatttttttttctgttatgtttaatctcctttctatctctgtgtcttctgatttcaaggcattaacactaatgagtctcccatgggttagtcatgggtttaagactcccgccatactcctgctggtgtccgcccaaatccacccagaggacaagccatgaagtgggtttgtggtggtggctccacctggtggctctcctaggaaactcctctttctgcccaccttttccttctccttgggagaatcttgatggaggatgcctttgattcctctgactcagtgttcactatttgtgcagttccatcccagacccacggcttctcacattacttatggatttttttagcccttttgctttttcgcctaagaattgctctttgaactcatataatctgtgtcctgatccttgttctatctgtgatacccctatggaccaggattattgttaatgaggattaaaaaaaaaaaaggactcccataggcatgactctagatatagatattaatttggacaaaataaagaatcacactgaaatccctgtaggtatgtatgccaaaatctcctgcctaatagctccaagtacccttatctacttcttcttcactttttgttgaacccatttttcctcaaaggagcaatattttattaccaatgttgttttcaattgtcagcaggtggcgaaagtaaaaagccaactaactttttggcttcattgttgtttcattattgtttgtgaattctctacaggcagcccccttcttgcctgggcacagactgcccccgcttggtatgtcactgagcataagtatttttgataaataaaaatgtcttttattctcattatttttcagtttttagttgttgataatattgcagatatgacttattttagctgcattgtgggtcagtctgggaacttaatcaccatttataactttgcttctatgggaataatgcattcagagttccaaactctctgcataaggcacatataagtctttttttttttttttttttttttttcttggaggcagagtctcgctctatcccctaggctggagtacagtggcatgatctcggctcactgcaactttcgcctcccgggttcaagccattctcctgcctcagcctcctgagtagctgggactacaggcacctgccaccatgcccggccaatttttgtatttttagtagagacgggatttcgccatgttggtcaggctggtcttgaactcctgacctcaagtcatcccccagcctcggcctcccaaagtgctgggattacaggcgtgagccactgtgcctggccaagtctgacttcttttttttttttttttttttttgcattgctgacatgaatccttaagtacctttgtaaaagtcagagtccgtataatcggtgcccactgaagtttgctcatgttgcagaggagtttataattcacacagtatagaatgctggaactgtgcaagctccacacagtacactaggctctgaggatagctttgggttcaatcacattgcaccattgtatatggtgcttattttcacaaggcctgagttggatcttagtgtgcccacgtttgtatgaggcatgtcgtgaaagtgggtcctattgtatatttccatctactagtgacgagaccttgcaccaagcgtgacatgctcagatagaaaccagcccagcatttctcagtgtgtgttgtatggaattatagcccttctgactattccacaaaggagggatgcggggagagacaggcagacaagcggggagagaaaattgcctctctcgtcaaatttcagctgcagcactaacaccatcttggagactgacaagcacattagcatagtacaggctctcagatggcctatggtaaggagacctgcttatctttgatcatggaactgcatgttattggatactagttaagactccactttgggatatgttgggctttaagatacaggacaaggagctctgtaagcatccccaagataatcttcaggttccacctctcatgggaaatgtttgagtaagtgagtggagatggtggtgctggcactcagagaaatgactggcgaggcttcttaagcctgcgctgtcaaaaaacatgagttagatgatgctaggagaacattctttgaatctgaaacttgaaagccagtcctcttggtagtttttcaagtgacaagctgaaagggaattttccctctgatcatttcttgggtccttgtatctaagaatgaggcttagacacatgagtggaagtcctagtctgggctttggcatgaaaagcaggctgaggggacccaacctagcaactggtgaggccagggtgttcaggtctacctgggacttggatcacgatggaacctgcgattccagaggtggtttttattatgatgacagtctctacatagtcaacatagtctcattgccttctctacttgctttgactgaaagacagaagtcttagcttttcccgatgccattaaaacactgaacgtttataaagaagagccttcttctctccctactagtgaaacaggctggcatttgagttcaagtaataaatccacatgtggggttgtgaggaaaaaccacatagcctgcctttttagaattctggaatcacagagttacagaggttacagagggacccacttattgacatcccaggcgaacgaacatggagcctctgcccagggaattgaaaaggacactccttggctctggccttggctaagccccacgtgggagcctcctttccaaagggaagtttttctgggtagggaactgctagattaatgaaaggtaatcaggccaggtgtgatgacttacacctgtaatcccaacactttgggagggcaaagctggaggatctcttaagcccaggagttcaagaccagccggggcaacatggtgagatgttttatagtctctataaaaaatacaaaaattagccgggcatggcagcgtgtgcatgtagtcccagccacttgggaggctgaggtgggaggattgtctgagcctcggaagtgaaggttgcagtgagctgaaatcgcaccactgcactccagcctgggtgacagagcgagaacccgtctcaaaaaaaaaaaaaaaaaagtaattagaggtagatgatatttaggtgctggttgcatttgttgcattatatggggacagcagctatattcacttgcagtaagctctggaaaaggggcattttcttctaattatatctgttgatctgtcatcacagcctggtctctctgatgccatgtgcagcctcagcttagtctttggattcttggctttttgtgcttctgaagccttaagactgttgtacccaaacaatgaggacatttcatggcccacctccctaactcatgattaggccaacagcgggcccagctgcagtgccaggtgggctgccctcattgtttcaaccaggaagggaaagagagaccagccagaagcttcctctgcatgtgcctgtgcatgaaaaagagcatttgaggaggactagcctgcttgtcgcatttgtgtttctctggagacctgaataggttcagtggcagcaggaccttattgcagggaggatggctgttgggaggacccagaccactcctgctgcacctccacagcttctgcagcactttagacaagttgcagattccccctgtgtttccaggtttcccatttgtaaaacaaggaaatgctcttgttaattccttcagggcaattgtgaagattaaaaatgagtaaagaaaataggttttgggatagggaggcaatagagtgaagtggggtagggtgtcactcactgaatacagtagtaattgctattaaaagtagtaaactgctagtaagaccccagagcattgggaaggaattagagatttatggaaaataataaaacgtgttttcatgaaacaacctgtgatcacatgcacatggcaccttctccaggatggaccatatgctaggctgtaaaagaagtctcagtggccaggtgcggtggctcacgcctataattccagcactttgggaggccgaggcgggtggatcacaaggtcaggagattgagaccatcctggctaacacagtgaaaccccgtctttattaaaaacacaaaaaaattagccggtcatggtggcgggctcccgtagtcccagctacttgaaagtctgaggcaggagaatggcgtgaacccgggaggcggagcttgcagtgagccgagatcgcgccgctgcactccagcctgggcaactgagcaagaatccgtcccccccaccccccccccccgccaaaaaaaaggagtctcagtaaatttagaaggattaaaatcatacgaagtatattctccaatcacaatggaattaaattagaaatcaacaatagaaggaaattggggaaattcacaattacatagaaattaagcagtatgctcctaaataaccaatgagccaaagaagaattcacaagggaaattttaaaatactttgaaattaatgaaaatgaaaacatgacatacaaaaatgtactgcctgtggctaaagcagtgtttcaagtgaaactgacagctgcaaatgcctatgtacaaaaagaagacagatctcaaattaatagcctttctactttctactttaagaaactagaaaagaaaagcaagctaaactcaaagcaagcagaaagaaggaaatgataaaggttacagtggaaataaatgaaatagagaatcgaaaaactatagaaaatcaatgaaacaaatagttgatccttagaaatgatcaacaaacttgataaaccttatctacactgatcaagaaaaaaggagagaagatttcagttactatatgaggagttaaagcgcgaacatcactaccaatcttaagagaaattaaaaggattgtaagggaatagtatgaacaactcacccactgctggtggaaatgtaaaatggtacagccactttggagaacagtcacccatatgacccagtattccagactctagaaaaatgaaaacatatatgtccacacataactgtacatgaatgttcatagcagcattattcataatagccaaacagtggcaacaacccaaatgtccaccagtggatgaatggctgaacaaaatgtggtctatacacaaaatggagtatcgtaagaaggaatgaagtcctcatatatggatgaaccttgaaaacattatgctaagtgaaagaagccagtcacaaaagaccgcatattgtatgattccattgatatgaacgtgcggaataagcaaatccctagagatagaaagtagattagtgtttgcctaaagctgaaggtgggaatggaaagtgatttttggtgggcgtgaagtttctttttggggtgatagaaatgttctaaaattacactgctgtcatggctgtacaatcctgcagatacataaatccatttaattgtacacttgaaatgggtaaattttatggtatgtaaattatatctcaataaagctattaaaaaatacaacacaaattggggttaaaatgctatgtctgtctgtctgcctctttctcttttatgtcccctaccactaacctccttcccacagctgagggacaagatgtgtcattccatttattcaagtctttaaaattatatatttctcagcaaagctttatatttttctttattcaatcagttgcctaggagatagtaggtctgagggatcaaaaagacactgttttgctaagggtgacccaaatattagataatcgatttgagaagggtagagaactggctgtggcatcctattgttcatttcttgagaaaaaaatgagattctctgtaaatcaaaagccaaacctcttatattctaaattctgtgcttcgtagaaagagcctctgctagaaaggaaagaatccatttatgtttccagtttttcttgccgttgtcagtaactgcgttggctatttttgctcataaatctttatccacagctctgatgatttctttaggaaagatttctcagatgtggaattactggacaaaagtgtgtgtatattttatggtacttggattcattatcaaattgacttcctgaaagcttgcactgatctgtctcactactgaagtggggagagtgctgcttagtgttctaagcttgaatttctcagattaatcgagtgcttgaacattttttcttccgtcatttgttaataatctttgcactttatattgaggtccttatttttttttttactggttggtgtactattcctttgtcattcatggcaaattttgcttcccaatttgtttgcttttcattttgtttacgattgattttgatgcacagaaatagtaaatttttatgtagattggtatattgatgctttcttttgtgatttctctgaataaattatcacctagcttatctcctttttttatactggcttcattttttacttcaaaattttaatctgtatagaattttgatgtgtagtatgaggttagtatacaaattgatttttattttgaaatagccacttttccaggaccatttattgaatagccctttccagtgattgtatgatacctcatttatcatataatattattatatatatgaaagtctttgggctttcaattctataccattaatttgttttaccattcttaatatggttaactattatggctttataatatattttaatatattgtatggcaagctttcagccttcctatcacccttcattttcaaaaaggatttagttactctcatttattttaaaatcatgtcatcaagttaaaattttaatttcattcaaattataagtcacttttagaagaattaacatttttctaacatttttgtttaaagctttgcattgttgcataaaccaactttatatacaagtatataagtgaaaaccttttctcccccacctctcctccccaaacatcacagtaggctaattcttgtaaattaaaacatctatccccttctgaattctaaacagcttattctagtcagccagtgacatgggatgtcactctgttgagtcaagtgttacagttttatttgtgcagtcttgcttgttgatgacgttattcccagatagatagtggttattgttggcttttgtaaataggatctttcccctcatattttttgtattgctggtacgtagaggaatttaacttttgaagatttctttacaatagcccttgtggaacactcttgctaattaaaaaaagttcctcttttatatttagaaaattattagtacctatcagtcactagttttcagaaggtggataagtggaaattataaaatgctgtatttgaacaaatgatattttagaaacaaaaattccttggcttggatagaacgctgtgtgtgtgtgtgtgtgtgtgtgtgtgtgtgtgtgtgtgtagggatttttatccaaattaaggaattttatatatacagttgacccttgaacaacacagctttgaactgcacaggtccacttatatgtagatttttttcagccaaatgcagatagataatacagcatttgtgggatgccaaacctgtgtatacagagggccgatttttcccgtgcttgagttccacagagccaattgcgagacttaaggatgtgtggattttgggatgcgctaagggtcctggaaccaatctgccgggaatactgagggatgattatatatgtatatatatgcagctgttaacagtgttatattgtatatttcaaaataaacagaagattttgaagttttcactacaaagaaatgataaatatttgaggcgatggataagctaaatacccttacatgatcattatacaatgtatacatggatcataacatcacactctaccccataaatatgtacaattattatgcgtcaattgaaaagaaaacttaaaaaagtggacatgtgcaaacctcaaaaaaaatcaaaagctaactttcattagttcatattatgaaaacaactgtttttgtttggtttttcaactatgacagtatattaaatgaaaaaaggaaaaccttagtcatctgatcttaatgatttgtaatctgatcttagtgatctgatcttaaatgaatttttttatatatttggggctgcatttcattctattaatgcatttttattcttccgcaagtgttgtgcatgtttaggtttttattttctttactagattataaggcgcttgaaggaaagaaaccacatcttattcatcttggagctcactttaattgttgaatgaagtatatgcttgtactcatataccctaatccttttgaaaaacaagttacttcaaggcaaactaccagagggagaactaacttattaagttacatggttaaggggaagctgttgaaattctgtgattcagagaaattgtctttggtttctgagtaccgagggagagaggagacttattaaacatctgttttaagagtggatcctagaataagtactaaacctaggtcttggcctgaccacaggcagtttactagagagagagaaggtgaaatagtttcagaggaggaaattgcaactagatcttgagtaatgagattgaaggtggagctaagttagaagggtaacactgtgctcaaagagaagggtcctaaaattttcacattcacttgtgtaacatgcgatggcgagtgcgagaatgtatacaagacaagggaaggtttcaatttcatgtgaacattttaatctatatttgattttacccttttgcccaaggttttataaatgaaagtgtaggccgggcgcagtggctcacgcctgtaatcccagcactttgggaggccgaggcgggcggattacctgaggtcaggagttcgagatcagcctgggcaacatggtgaaaccccgtctctactagaaatacaaaattagccgggcgtggtgacacatgcctgtaatcccagctactcgggaggctgaggcaggagaatcgcttgaacctgggaggcggagggtgcagtgagctgagattgcgccattgcactccagcctgggcaaccagagtaaatctccgtctcaccaaaaaaataaacaaataaataaaataaaataaaataaatgaaagtgtatagagttcagtttattttctatatagatgtgtactcttccctttttgttggagtacatgggccagacctagcttttccttcatttctgggcttttccttctctgatatttgattcctcatcactttcatcaggaccagggagggaaagttaattttggactatgtgattatgcatcagttttgcctgtcaggaacctagtattatgaatgattaatgattagtattgttctaagatttcaatttaggtaaaatttatctctctaaccacctgcagcttgcttgttgaagattctgtaacactagagcagggaggtgacaatccctgtgggggtggcctgagaagctcttttctcccctcccacccttagtctcttcttgcttctttttcctctctgcccccttcttttctccctagggcccacttggatggattctttggtattgtcattccttacaaaggaaaataaaaattcccagatagtttgccactgagttttccctttaattattttacccctttgctagcccacattatttgagagattaaagcaaacaaatgaacacagcgtgctgcttaatagttatttcttttatggaaatagagttctgctatgttgcccaggctggtcttaaactcctagcctctagtgattctcccaacttggctgctcaaagtgcttaatagttattttttttaaatattgtttagggaaaaaatgataccagttgttttatatttgaccttttttaaaaaaaagctttaaagcagctctttgataatatcactagaagtagtttatttctttttgaagaaattagcttcctttgtaatttacttttgactacatcattgagataaaaggtaaggcagttgaaactatgtacaaaaaggaaaaaaaaaatcgctcagttactgatgggtctggcactgtgtggttagggatgggaaaaccagcatacactagaaatgaaaatcctgtttctatttcatacgtatacatatactttaaaaactttacatgttccctcctaagctttggccctgtagctcttgcccttcttgcacagaactcatgtgcaattcacattaatgttgaagagactcctttcctccctccttctctcccttcttccttctttcctctgttcctttcttcctctgactctctctccatccttctcttccatactttctaaggaccatcccattctggagtgggcccttagggtgtgggtatatttaagtgtgtgtcattagctcttagttaccttttcacagagttgatgggaataaaatggaccattgaaatccaggaatgacccacagaaatgcttttgcagtttaactctaaacctttttattagaaaggcttatataggatgtgatttcacttttctcacttcctgctgatcctctcaggtggaggtgatcataaatttaaaaatgaccaaacctaggcagcaagaaggaagagaggtaagcatcagctggggattttgtaggatcagtctctctccttccacatgttcataaattatgaactgtatcgatccattcacattgatgtatgaactcattctgccaaaagcccaagttgaagtggaaaatggaaagtgatcatttattagagctgatgagtgtcagctttgtactgaaacaaagaaaacgaaaccacacaggcctggacggcctccccttcaaccctaagattctgtggccagaggcaagtgggcctgggggtaaccagcaagacttagtaacagtttacaaatatcctgcctgttttcagtggcttggaatcagactgttatctccttgaggctggaaaagcatttctgtgcctttatctccccatgacttctgcccaggatgattcagacaccctcactggaattatcttcatctgaataattctcagctctatcagccattatcaatgttgggaaggttatttcacctttttaagcatcgatttcttcatctgcaagttgaaaggttgagaagtttctagtatgtcttcagctgggcatggtttctaaaagcttttgttcctatcttcatcagaacataactagttctccagttcagggtcatggtactgtttatatagagtcctcaaagcattttaacctgtgagccctcatttggttattaagcttttggaaatgttgaaaagcttaagcatcccacttctctctttgcaaaccctccccaacgttcccaggaagaaatattggggtccagtctgtgtaccatcagcccattctagctcctacagctgacaaacatttgttgaacaaatcaagttcccacatgaccagtcagaagcctctggagagcttcaaagaattctttgctgagaatgccccatggtgattttgttgagtaatgaagttaaaataatgtttctgtctttggtaaaccacccattctcacctactgcatggcagcatgggtttctgccagtctttactcagcttgattgcacaaggttgggcaggtggtgagatgtgtattcactttgccttcagctcagcatgcttcagaatacaggtttagcatcccaaatgtgaaaatccaaaatctgaaatgctccaaaatctgaaactttttatgtgctgacgtgacgtttaaagaaaatgctcattggagcattttggatatcagattacagatactcaactggcaagtataatgcaaatattccaaaacatgaaaaaaaaatctgaaatccaagacacttctggtcccaagcttttctgatgagggatattcaacctgaactgcctcttccaaaggcttttgcatatcatctccatatttatttcagtgggtgtgggatagaatcacaaattctagctgccagttccttctcctcaacctgttagatgatagctaaagattgctagctaagtgatacttttttatttgagatggtgtctcgctctgtttccaggctggagtgcagtggtgtgatctcggctcactgcaaccgggttcaagtgattctcctgcttcagcctcctgagtagctgggacttacagtcacgttccaccgcgcccagcacgtttttgtatttttagtagatactgggtttcaccatgttggccaagatagtctcaatctcttgaccttgtgatctgcctgcctcggcctcccaaaatgctgggattacaggcatgagccaccacgcccggcctaagtgatattttttaaagcatgtttaatatttcaaaatgaggttttaacagagacacatagaaagggatcaacaagggacttgaacaaatatttgcacacccacattcagagcagcattattcgcaataggcaaaaggtggaagcaacccaagtgttcattgaggatgaattgataaacaaatattatccagccttaaaaaggaaagaaattatgacacatgctgtaacatggatgaactttgaggacattatgctaagtgaaataaaccagacacaaacagacaaatactatatgattccacttatgtgaggtacctagagtagtcaaatgtatagagacagaaagtaggatggtggtttgcaggggctgagggagggataatgggcagttattgtttcataggtatataatttcagttttgcaaaatgaaaagacttctggagatggatgttggcgatagttgcacaacaatgtgagtgtacttaatgccactgaactgtacacttaaaatggttaagatggtaaattttatgttatgaatgctttaccacaataaaaaaggatcaagaataacatgacaaatacccaacacccttctacccactaccagctaagaaattctatcaattagcaattacagttgatctgtcatgtatgttaccttgtctcagttgcattgtgtgtgtttcttgagaagcgtgatggatgacttgggtaagagaattctgggtcaagagagcattccttctcctgttttcttttcatttttatttgttagttaaagataaacatagtacaataagtaaaaaattaataacctttctctgtcctttaaaattagtgttcctaactctaaaaagcaatgtttctagaaacttctgtttaccctttgggctctgatgaatgtggagaaaagagagagaacacttaactcaccaggatggaagaataagataaaatatttgcaacctccttcctccctgaatgttgtgttaaacgtttttttgaggacttgcgctgtgtcaagtgttgtcgtatcagttatctattgctacaatattgctgcataacaaattactacaaaaccccagcagcatacaacattaagctgctctgtgtatcttgcttgcattatgtgtacaacaaacccctatgacatgagtttacctatataacctgcacaatgtacccctgaacctaaaataaaagttaaaaaaaaaaagaattaggaccttaatgcaatcagtacgccctagttacctatgcaaatgttgtagtggagacatctatgcagtcctttaaacaaccctgagaagtaggtggcattggcctcattttgcagttggaaaaagcaaggctcagagaggttataagacctatccaaggccacactgttagtgagtggtgtagtttgggtttgaacctgggtctgtcagacgccttcctccatgccgcctctgccaaactccatgcagcaccttggattaccacctatggaaacattctgttttgccttttgtgcttctatttgcccctcccactcccgctctactcctttctctattatatttgattgagtcctcttctccaacttctgaagtgtaagctgtttctatagtcctgtctttggcatcttcctgggttcagctaatgccatgaagcatacgattccctaagcccaacctctaggctggccctccctccttgctgccttcatgtccactctcagacactctgtgctggctactggtttctgggctgcaagtcataggcaacgtggttccatctggcgtaggtcatgaggaaatacctgtcttgtgtaacaggaagttgtacacacacagggcaggcttgtcagggcccaggtttcttttctgtgccctgcctctcctggagttggctttgtgctgtgaccagcaagtggagcaacagtggacttcccagtttacatccagtggggaagtgcaggggacctctcttcatttagatgctctgggcagacccacctttgtctctcactgtaccaccctgacctaggactgcctgcccatccctgaacctatttctggtgggagctgacccacgtctggtggtctgtggtggagtggcagatgggagacagtcactgtgtccccaactgtccctatgtggttgagcagcagattctctctcctgtcagactcctgttgcttctgtattctgcattttatttgtttttatttatttttttgagacagggtctcactctgtcactgaggttggagtgcagtagcggaatcatggctcactgcagcctccacctccagggctcaagcaatccttctacctcagcctacccgagtagctgggactacaggtgtgtgccaccatacctggctaatttatctattttttttttttttttttttagagtagagacagggtcttgctatgttgcccaggctgggttcaaactcctggtctcaagcaatctgcctgcctcaacctcccaaagtgctgggattacaggtgtaagccaccgtgctcagctgtgttctgcattttagttggtggcattaccaaccttcacttcctcccatcgacactttggggtcatttttaattcttctttcttcttcatccccttatttacttacatgttttgttctaactttgtttatgagatggttgttaaaggtctgttctgggctagcctgtagtaatccccaaggaggccagctgagttcctgttcacagagtctaggatttgagaatcaaacaatccccaggcagcgtgggcagggtaaagagaacattatacactgggtgctgtgctctctcatggttgttattggtggtggtggttgcaggggaccataaccctgcctcaaaagcagtcagggaaggtgtctgggagggggtcacatgtaagctgatgattcaaccttagccatgtctcttgttcttcctttttaaaaaaatattccctggtttctgatttggactcttaacacttcttcctataaaccagaagtcagcaaacgatggcccatgggccaaacctggcactggctgtttttgtaagtcaagttttattggcacacaggcacacccattcatttatgtgtggtctatggttgttttcaccactacaatggcagagttgagtagttgctacagaggccatatggctcacaaagcctgaaacattgactctctggccctttacagtaatagtttgctgatctctgcggcagaccattagaaaaaccgaattcctgcctgccgggaagtttcgtcttgcaaaaagagatatacgtaatatatagaaaattttataataaagccctttgaggtaaagacaattaagtgctgaatacaatatttaaatgctgacaaaaattattgttggggagattaatgtggatttatttttccctactttctctatttttctctgctctttctctattctgcaaatgaatcttcattcattttttttcgcctcaggatttttagactgacactttctagatttataacttctaagtttacacttttcatgacactcactttctgccctctgagagggggaggaaaggtatggatcagtttggaaaatgaagtctgggtgagatataaccccctcttttaaaaaaatacacctttgcacctttcctgtatttacaaggaaagtgggatttgtttaaataaagagaaaagtctttatctgcttcgaataaatagataggacgtgcattactaacctgtttgtttggtggggtcggcgggggacatctgcttaataatctgcccttttctggatgatgcttattccccaccccaccaagaggggactgatttgttgtttttctgatccccacacaatcatctgctcagtagggcagcttttgtgctattgggttgtttacacctctctgctcttttaaaacattttctagtttgaccttttcttttagactcatcctaacttttcttagacttactataaaaataatacatgtttagtgtaaaaaattaacagagtcaagtcatggtgtaaagagtcacatcaaatcccttccctgagtcatacttcctggaagagacttggttcatggtcatccctacagatctctgtgtagatattaggaggaaccataagcagatgcagatagtcatttgatcataaagatgtcaatttcaaacacatagtggtacatacatcttggcattttttaaaaacacagatgggatcatactgttcaggctatattgcaatttttgtattaagttgacgagaatcttggaaatcttgccgtatcagttcatttagagctatgcttctctttgctagtttgtgtggagatacacctatggcttaattaaccagttccctgattgaaggacgtttaggataattctggtttttcactattctgactaatgtagcagtggacattatgcatatatctttgtacatttcatgtgagttatctggagtataacttcctgaaagtggaattggtgttttcttgactcttttacttttaacacttttttttttttttttttttttgagacggagtctcattctgtcactcaggctgaagtgcagtggcgtgatcttggctcactgcagcctcaacttcccaagctcaggtaatccacctcagcctcccaggtaactgggattacaggcgtgtgtcactacgcctggctaattttgttttgttttgttttgttttttgtggagatggggttttgccatgttgcccaggctagtctcgaactcctgagctcaagagatctgcctgccttggcctcccaaagtgctgggattacaggcatgagccagcatgcctggttgagacattttttttagacttcttttttttttttgaagaactggtcagatgcctctggtcccagctggccatgctgaccatagggtccttcatcctctagtgataccacagaaatggacctcagtggaagtcaggcaatccctccaggcagatcctgtgcaattataaacattagcatcaacttccctccttctatggaatatttctgtgcttgcagcccggcaggcactggggacggacacacacacacacacacacacacacacacacacacacacacacaccagtgcgcacgcgcacacacacacacacacacacacaccagtgcagctgagtagggctgggagcaaggggtgtgtatgaagccgtgtgggtacatggaagccctagtgacctctttatacccgaaggatagggggaaacttgtagtgctttccagaatttaagtagtcagaaaagggagagaaaagtagggctgagttgggggagggtaatgaggctgtggcaggtgtcagcctgcaaattagctgtgctggcctccctggaagaaatcatgggcattgagctcagccaagccagggcaccagatgacagagtggggctctcgccagccactgacccaagtaataagagggcacttggcaagcagcttcatgagcaccgtgccacgtggccatttgtggttcaggacttgcgaagttgcccaaagtggctcttttgttatgatgtgttactccaaagcttatgaagcattccaatgaacagagtccaaatgttatgtttactgctttgttaaatataaatagtttacccttgtacctttgggtttccttggaaactgtaatttttttaaagataggttcttgctctgttgcccaggctggagtgcagtggtgcagtcatggctcactgcaacctagaactcatgggctcaagtggtcctcccatctcagcttcccgggtagctgagactacaggcacacatcaccatgctctgttaaatttttttatttttattttttgtagagacaggttctcgccacgttgctcaggccttgaaattctgccctcaagggatccttccaccttgacctcccatagtgctggaattataggtgtgagccgctgcacccagcctggaaattacaatcttgaaagcagggattgggggttctttttatttaaaaaatttccatggaacctgtttgccagtctggtgaagcctgtggaccccttttcagaataatgttggtaaatgaataaaaagggaaccaaagaattacaaaggaaaccaattatgttaaaatagttgtcaaaatagtacaaaaatacaagcaagacatatgctttattatagcaacatccagcagtgggtcaggaggtgatcataattttgaagcaggggtgagtgtaaatgatagttcaagataactgcaactgtgaaatgaaatgaaaatatctattcatgtagtgggaaataaataaatttcatagatgctgctagtaccattgtggtttgttgcttagattcacggtgagaataaaggccaaatttcagaagatagtaaaagatgtatttttcttcccatgtaagtttagaccccctgaattctatccacacaccccagttaaggacctctgcttaaggggtttagcctttcagattatgaggaatgaattgcagggatataaactcccatttgcatcaagaaaattcagaaatacctaggcttcctcccctctttattctgatggggatgagaagggaaactatattaaaaatgagtcaaaatttaaaaatattatgactacctgcaatgaagatctccccctacccccaaaagagagggtacatgtggaattctttgacactttctaaatctccgagcacagtggccatttttggtactgattttaaaaactgggaaaccctagatttgtttatggtgtgtatctcccacccccacaacccacacacacatacctcccagtaattctctaagattaggcaagacagaagtatcccagatgaaggtctttaggattttctagacctttgttacagttcttcaaatgtttgtgtctttttttctcctctcctacccctcattccctcatcttttccccctccctgcccattctacctttaactgtaaaagttaggtgtctgatatattcatttgtcagcagcaaagtttgagaatgcctttaaaaatagatatgttagagggagtatgttggatagaaaggagaaatcttgtttatgctcaataaataacttacatttagaaccttccttcaatttttcctttgaaattctgtattctcatttcacttgaatgactctgcatggagcgtttaaaagtagatcaaacaaaaccctataaatatgttgagttcttttgggcattttgccaaaattagccttgcagggaaaagcagtgtgctttacgtattggattttctcctctgaaaatccagactccctctcctctggagagctagctgccagggctgggggaaagtcaagccagggacacattagggaagtgtccctggtatggcctgctgaggttgggttatttggattgagggttgtgctgaaaggccaaaaccaatgcctgggaccagcctgaagaaagatgaaaagcagagggacgtttagagacgtcactgattttatgttatgacgtgattcctttatctcactctgattggaagggaaggctggtgaaaaaaacattaacagagctgtcttttaacagattcctgaatgtaaagccaaatggaaaaaagggagagagtcaggtggaagtaagccccttggaaagtaggtctgtctccatcatcccaattttatacgtgagaaaaccgaggcagagagccacgcaggggttgcaatgctgggtgagttgggccgtttgtctcttctgtattgttaactcagggttctctattattattattattattgttattattattattattattattattattagttagaggtggggtctcactatgttgcccaagctggtcttgaactcctgggctcaagtgatcctcctgcctcagcctcccaaagtgctaggattacaggtgtgagccaccatgcctggccccagggttctcttttatgtgctttaatgctttaagtgaagaccacgtatccatgagcagtgaaatcagagcccctgcaccctttcacatggctaattcacatatcatttttataagatatagttgaggtggaggatgttgagttcttcatgctcatggcaccaaaattacagatgtggcttctaaagaaatatcagatgacaatgttaatgttaaaatatacatatacagctcctctttgcagaaactcagtttattcaatggatggcccctttgactattacgttggaagtagaaacttgatttgggggggtcagatgttaattgcccaaatttaagacagttttcagtgacttctttaaatgaggcattagactctgaagttcatagggctgaggagggcctggatcggggattttctagatatatggcacctggggtccacatagggatctagagtggtgcagtggcatcgccctaaccatcatgaggcagatgtgagtgagtcgaattggttgatacagatgtgcgtgaaagagctgagaggtgtcagggttgaaaagatggagacagacagcaaccgacactcacagataacaaaaacacaatggaaggaggacagtgctagagaaaagcaatggttgttaggagaacccagagaaggggcccccacggctgaatgaatgagtatgtatgtgtgtgtgtatgtatgtgttcccatgagtgaggggcgagctcggaagatggacaccacagggcccctccacctagtgagagatggctgtctgggctgtgtaggctggtggtgtctggccagggaagataaccttggcttggtcactgatggaatagtatgggcctcctcagggttctgtaacagcatctgatcagaataatgactaatgtgggctacagatgtggagccctgtctctgagctcacacctcctgctgtgttcgtagaccagccacaaccagttgtcattgggaggtccgaggccccttgtcattcagccccatgaaaagcacctttcttgctgattgaattgatatttatttctttcaaaacaccaactcactttaccattaatgtaatcaaagtgtgatcagaaaggtaagtttcataatgcaaggtaattattttaataggtgactgtgatgtttttaaaaagtgattacagtatattacgtgctctttgtgaagacaaattgatattgtagaagcatttaaatgagtttctacccttcccccaatctgcctcccctgaagtatcactgttactttggggtatagccttccataccattttctgtgcttacacaagtgtgtccgtgtacatataccccctttctctcattcatttgtatctttttttgagacagtctcttactctgttgccctcattcatttaattgtattagaccttcataaattagttgaatgttgaatggattcatttatttattaatgaacatttgttgaatgtatactctgtgctaggttccgagttatcaggagtaactaaaatgctacatgctgcttagagttatgagtgtgtgtgtgtgtgtgtgtgtgtgtgtgtgtgtgtgtgtatttataaaattgggatcatagtatacatattacgtgatttagtcttttagtgtactatggacaccttttcacactgatacacgtagagctacttgttatatttaatggctgctggatataccttcccctcccagtagacatccaggtttcacatgtagatctctgtgcatatatgcatttgctattagaaacaatgctgccctgaaccttcttatacatatatctttgcctacttaaaccaaatgttttctgtcttttaaggggaccgaatataaaatcaaacatacgtcatttcttgttcatatatagccctgctctacggtttagtaaagttaattcacagggggccatacgtttgtaagaggaaagcagttagaggcatagattagcattatttagtattacagatgcttcagactacaaagttgatggagaatgagttggtcaattaattgaccaacttcgacacaccaacaagactgcagggtctaccatctttccatccctatagcatcaacaattccagatggcattgacttttgtttgtttggtatatatatatttttgttttgagacagagtctcactccgttgcccaggctgaagtgcagtggcacaatcatggctcactgcagccttgacctcctgggctcaagcagtcttcctgcctcaacctttcaagtaactggcactgcaggtgtgtgccaccatgcctggctaattttttaattttgtgtagagactgggtcttgctgccctgtttaataccatgttgaagctttaactccctttccctccacctttcaggatgtggaattcattagttcattcatttgtcgagaatggattgagtgtctactcaaacagacactgagctaggtgcaggtatgaaggacaagtaagagaaggtcattggcccccaaaggaggcaacaggcatgtcagctgacaattgtttggcgtatgtctgtgtccatgtctgctttgtggcctctccttctctgggtgtgtaattctttccactgtgtttttccagctgtgtctttcattcttctgctgggccatctcctgcttctgggacccctccccattgccattctgcatatccctgacaccgagcccttctccctggatccctgtcctcatcacatcttgttctacgcttctctatccagaagcctcctctggtttcttattgcccacaaaataaagtcctcatctttagcttggcatccagagtccactagaaactcactcccaatctgccttcctggtatcatcttgcgttggtggaagaagagggctgaagaccacaacttatttaacccatgtaccctggacaagttattgaggcttcctgtgctcatcataaagatggggccagcatgctgaacctcctagagttggcctcaggacatgagggaaggccagttacatgccaagcgtggttcctggcatgtagcaggcactcaatgttcatttctttcttttccaagatgaaggtgatttttcttctgtgacttttgatgttatctgcctcccttcctaccctccatggctcaaaggctctaataaatggttccctactagttctacattttctcttatatcctgccaagacttgggagaaaatgagcactggcatagctatacccacttgtcagatgccctctgcctttgaagtagcaggcaaatggatttcctgtgttctgcggtgcagagatgttgattatacacatccctgtgaaaatcaagcaggctcatctccagggaccacacaatgctggttaattaaatattatacatttccactgcaacagtccaggtacagccaagaggggtttgtaaagaaacacccacagggtccttttatttggagtgccattggcttctgaagtgtcctcctcttcctgtgagttgcattatgttgaaacaggatgacgagtggaaatgtttccagtaaagagtatgatgcaggggttctgcaagatcggtaaatctaccttctcttcccttgtactcggaatctactggacgtcccaagtaaaaaatgtgtgaatctatacatttagttaagtttgtattgttttctccatcctgagatagaaaacatggcttcttgcataaattgaagtttccaactcaagaacagcctttaaagaagctggcatgctgctcagtaactggggagttgctgccttccccccaccccctgagcccctggcacctagcagtgtttgttaatgaatcatagcagagacgtccatcttctccactctcctgccccaacccaggaacacatttccagagctagaaactacttactgcaactgttccaaaggtctgtgaaataaacatcacagcacagcagcattcacctgtgctatgtattaaatactattgtcagatatttagaagtctgagttctctcccttgtgggaaaagacaccgaatgtaggacctaaaataacctgatcctggaagagtcccattcgtttttggcctgatgctcttctttgggcaacagatctgactaggtgtctctggaccttggctgcacattagaatcacatggggatcttttaaaatccagatgcccaggctgcacctcagaccaatattgacatttgaatctctagaggtgggtccaggcattggtatttccccttaaaatttttaatcagaaaatattttaatgcacagaaaatttgaaacaatagtacagtgaacacccacctagatttaccaattattagcattttgtcacatttgctttctatctctatcctctatccaatctccacacatactctttttgattactttttttaatcattgggatttttggcgttttttttttttttttggagacaaggtctcactctgtcgcccaggctggagtgcagtggtgtgatcacagctcactgcagacttgacctccccaagctcggacaatcctcccaccttggcctctgtactagctgggaccacaagcacatgctgccatgccaagctaatttttcattttttatagagacgaagttttgccatgttgcccaggctggtcttgaactcctgggctcaagtgatcttcctgccttggcctcccaaagtgctgggattacaggtgtgagtcactgagcctggcctgatttttttccttaaacggtttgaaaataaattacaaacatcaggacacttcatccctaaatacttcagaatgtatctcctaagtatgaggacattctgctaggtaactgcgatagaattaacaactccggaaatgtaacattaacatgctattatctagaattagttcatattcaaatttccccagttttctcaatgtttttatagccttttaaaaatgcagaattcaattagagatcatacattatatttagttgtcatatgtctttactctttttaaatctagaataattctctagccttttaaatatcttttgtgatattgacttaagaaaaaaatatttctgtgcctagcttatttcacttaacataatgacctccagttccatccatgttgctgccaaagacaggatctcgttcttttttatggctgagtagtagtctattaggtatctataccacattttattttcttttttttaaataaattttatttttaatttttgtaggtacataggtgtatatatttatgggatacatgagatattttgatacgggaatgcagtgtgtaataatcacatcatggagaatggggtatccatcccctcaagcatttatcctttgtgttactaacaatccaattatagtcttttagtaatttgaaaatgtatgattaagttgttattgactatatcatcctgttgtgctatcaaatagtaggtcttattcattctttctaactatgttttttgtacccattaaccatccccatctcacccccgacctgctcccactacccttcctagcctctgataaccatccttctattctctatgtccattgggttcaattgtttggagttttagatcttacaaagtgagaacgtgcgatgtttgtctttcggtgcctggcttatttcacttaacataatgatctccagttccatccatgttgttgcagatgacaggatctcattctttctatggctgagtagcattccattgggtatatgtaccacagtttccttatccacttttctgttgatggacacttaagttgattgcatatctttgctactgtgaatagtgctgaggtaaacatgaagagctaaaaaggttgatctcgtggaggtagagagtagagaggttggttactggatacaaacatacagttagattgaaagaataagttctagtattcagtagcagagtagggtgactatagttgacaacaatgtgtcgtatatttcaaaatagctagaaaagaggaattgaaatgctccaaatacacagaaatgataaatgctcaaggtgatggacactcaaataccctgccttgttcactacacattctatgcatggaacaaaatatcacatgtaccccctaaaaatgtacaactattatatatgaataagaattttttttttttggctaggtgtgatgactcactcttgtaatcccagcactttgggaggctgaggcaggaggatcacttgagcccaggagttcgagaccagcctaagcaacatagcgagaccccatctttacaaaaaatacaaaaattagccagtgtggtagctcacatcggtagtcccagctacccaggaggctgaggtgggaggatcacttgagcctgggaggtcaaggctgcagtgagccaagatcacaccactgtactccagcctgggcaacagagtgagaccctgtctcaaaaaaaaaaagtttttaagaaaaaaatcagatgagttttttgtttgtttgttttgttttttttgagacagagtctcgctctgttatccagattggagtgcagtgggacaatcttggctcactgcagtctcctgggttcaagtgtttctcctgcctcagcctcccgagtagctgagactacaggagtgcgccaccatgcctggctaatttttgtatttttagtagagacagggtttcaccacattggccagatggtctcaaactcctggcctcaggtgatcctcctgcctcagcctcccaaagtgctgggattacaggcttgagcgaccatgcctgaccagatcagtttttgtaaacggctcctcattttaaatttgcatgattgtttcctcgtggttggatttaggtaaatgttgtggcagaagtattctataggtgatgttatagaagtattctataggtgacgatattctataggtccttctcagtgcagcctatcaggaggcacgtgatgtcaatttgtcctatgattagcaatgttaacttggatcacttgggtaaggctgtatctgccagctctcttcattccaaggggaccattttccttttgtaactgtggggagatactttgagatttggtaaatatcttaatccccaacaagctttcgcccagtggttttagcaaccgttgattcttcccagaatcaattattactatgatggttataaaatggctattgtctggatatttctatcatttctgtatttgtcaatgttcttttgttaaaaaaaagagaaaaaaggagctttcacttctcaccccataactatctatctgatcttctttagctagctgtctagctacctgttaaacatattaatatggactcatgaattttttaatgaatgtattgtaataaattccctcagtacataccgtattgtcccaactttggtcagtggaagccctgtctagctgactcctgtgtccttttgaaattatcccttaaatgtttgagtacttcatgaattttagcacaaccagatattttagtctcactttgtatcttctttgccgtaggcttagaagaagccatttttctatggagacctagttcctctggagctgctatttaggaaggcatcagtagttttgtgaaagctccctagtcgatttcaatatgcagcaaagaataagagacatagattagagtcttccaaggggagaccacctgttcccacaaggtgtttcttttcttttaatcacctgttatttgtggtgctgatttgttgctgagatttagattttcatgtgtgttactcaagagatagctttaaatgcaggtccctggccccaaccccaaagagtgagttcagtagttctgccttgcattttaacagtctggtgcaggtggtccccaggccatacctgtagaaaatgccagaagtaaccctggaaactgggaattaggggtttcttttgattttcctcttttgctttttatcagtggtttctaccttgcaatatgatttcagaatactgccacgttccccaggtatgtggtaaggatctaattgattaatttgatggattctttgaaaatatcagatgatttaaacccttgtagctttactcttgttccatcatggggaattggggatgtgaaaaaaagaggtggtggggtgggggtggggtgggaagctttataagtgttggaagttttcagttgacccaaagacttttttcatccaatacattatttgttgttattagtttattttcacggacactgaatgaattggcctagtaaagttttcacatgctgtaagatcctaggatgtaggctctaaaatatagttgtgtgtgctgttttggggactgggtcatgacaccgtagtcagtttctgctatttccttttctgagaaggcaattaattgcattgcctccccatccaaccagctttattttattaaatctggggcctgtagggcccaagtgcccagcagctgtaaggaaaagctcctgatttgtggtttttcccttcctggttccacctttcaaacaaataccatgttagtgcagctagtcccttctgtgatctcaagacccaggactgagaatgcttaagaacagtcagatgtgggagggagatagtgcttctggagttgcgttgcctggtttgaaatcctctggtaaaatacatgatctctatgtgcctccgaggtcttcttgtctgtaaaaagggggttagtaatctaccccagaggttcagtgtgaggattaaatggggtggcatatgtaaagtgcttagcagtctatggcacatagtaggtgctcaataaatgttactattttattaaacagtaaatggtcacaaatggaagggggccgtggggtctagtgagagagttgagggtgtgctgtctcagttatcattagatcggctattgtggtatcatagtgcttgtgatcaacgaacccttatttcacttaatacagttgttcccccttacccgtgggtgctacatttcaagacccctagtggatgcctgaaaccatgaatagtgccaagtcctatatatactatgtctttccctatacgtacatatctatgagaaagattaatttataaattaagcgcaggaagagattaacaccaataaataataataaaacactaataataaaatacaacactaacaatatactataataaaagttatgggaatgtgttctctttctctttctcaaaatatcttattgtactgtacttagccttcttatgatggtgtgagatgataaaatgcctacatgatgtaatgcagcgaggtgaatgatgtgggcattgtgacgtagcgtttggctactattgaccttctgatgatctatgagaatgaggatcatctgttttgagtgatcctggatcgtggagtcacaacgctgtctgtggttagatgtgaggagcagacagtgtcagtgactcaggggcagggaacatccgtagcgtggagacgctggacaaatggatgattcacatcccggacaggatggagcaggatggcatgaggtttcatcacactactgagaatgacatgcaattgaaaagttatgaattgtttatttctggaatattccatttaatatttttggaccttaggtggccacaggtaactgaaactgcagaaagtggaactgttgataaggggggactactgtaaaaattccactcccagttcatttggacatgaaggtggtggctcaaactaaggaattccaaacctcaggcataggcaagtcataagtttttttcctttagtttatgtgagctattgaaatgaggtggcattgtcatctccttacctctttaaggaaggtcaagactcactagtaaacaccagtgaaattccaggagaggaaaaaaatgacaaatgactttcttagacttccttaagtttaagatggatggatgcaactgaaatacaatttctcccaacttcaagcatcccccttgaactgggttgtaggtcaggtggtactggcaaacaaattcaaatcagtgacaggctatagttgaggcctcgaaaagcagcattccaggagtttggtgttctctgtaatgagaggtccatggcagagacctaagtgacgtggtacagtgttgcaggaagaagttgagtacagattgcagagagtttggcacaaaatgtgaattgaattagtttatccagcactagagagagaactatgaacttaggctaaggaaatgctgccacttactagcttggtgacctggggtaagtcattgagtcctggattcctcatttgcaaaatgattgcccattctggcttttattttttaactcatgtggttggcaggaggagagggtgatggatatcagaagggtttgtgagctatcccagtgcgagggcgaatgattgtgcttggcatcaggtcacgtgatctttaccaccagccacctctgggtccctcccctgtgccctctgtagggcttactctttggcatgttggcagtgagctttgtaggactttatgctaccaaaacagtaacagtcatgaggctggactagcctggcagagagaaagtagcgaagacatcattcttctgacaccaggcaggcctttatggaagtccgatgcggggatttggtttaagagcagtctcattattctgtttcaggtcctacatccattgggttagtcttttctctaagaatagatcactctctcctttgccatttgtgcagtgttggattagatgctactttttacagagggttttttgaacatatgaacttacatacaactgtaagttttatggcttcagctaacactagatcttcagatggtgttattttaagtcactttggtcaggactttgacttctgtggttgtgagtgttggttttcagacgtttgtcatttcacttgtttcatgttcagatttgtgtctgcagagtttgcttttaacataacatccagcaaatgaaagccctttaaagattggtagtagaacttcattttaagaagcatctatggggccagtggagtcgcaggggtcaggagtgggatgccaagattgccttgtaatctagactttctttgctagaatgagaaatccatatcctttatggtacagggtacttgatttgccttccattgtatgggaagccatggtatagtggtggcgttctttgcatcggaatacccattcctcctgactttcctccttggaaaagcaagttggagtgggccctctgtcctagggagagccaagccctccttggggttgcactactcagcctgctgacagtgccatcagcatctaggaattgccctggaaatgctgtgtttgttcctaagacccagaggcttgtaattttgcacaaaggggtggagagtatttgtggagtcaccaaagatgtgattagacaagatatcgattctgaacttctgccctcttccttctattcaactctgttcttgcttagtgaggtacaggcaagaaaaatggaacagagagaactaggctgccggcttttgaaacatattgatcagggcacacatccgatgtagcacagagaccttcccctttatatgatgtcatcctgcattggggccttaatgtgccctgtgatcacctctgcatggacttcctttctcagagaaaagattagagaagaaaaagaatccctgtaggcagtgctaaaaaataatttaagcatttctaaatgtgtttctttgaagtcattgatccctttggttttctaggccatgcagtggcatgaaggaatggtgtgaggcggtcagccatgaacgacaaacttctgagcaatgtcggtctcacttcctacctcccatccacctccctggcttgggcctccactgctgtctgtctgtctgtctgtctgtctgtctgtctgtctgtctcaccctcacccccatacacgttctttctccacatagtgcacatctgtggtgtggatatgctgtggacagttgtgtctgtacttgaaccagctctaagccagggtctcccagataggacatgctgggtgagtgagatgttgtaaccctgagtgtcctctggttgagtgaagtgtggccctggctcttatcttgatttgtctggcttggttctgcgtaagtagctggggatcctgttaatggatcccctgggacagagggaagaggacagaagtagatttgttgaatcctgtgggggtgtttgaaatggtaccaagagcaggctgaaatctaatcagccttcacttatcaggcttgagttcccgtatgttgaaagggtgacgattagtaagaaaaaggccaggatactttatctttcctttgcacatttagaaaaatcccctctgccttgctagcattagaagcagaccattcttttttctctaccacatcacatcagcttccattaaaaatcaacagcagcaaatacaaagccccatctatggaaaaccgtttaaggcaacactgtgctccagtgcttcaggggtggggtatttgccttctgcaccaatggatcggtttctcatatccatgcctttctgacccagcagcttttaaaagaccaagaagcattgctctgctttctactgcctctctctaagagaccagggctgccgtgcctcaagccatgtcccagagagcatatttgagacaagtcagcttaatttgcctgcatgcctaggaagcctctctttaaaatctgatttggggagaagagctgtctctaaatattttgcttttcccatccaggcgagcgacggaggcgccggtgccaggtggcattcagctacctgccccagaatgacgatgaacttgagctgaaagttggcgacatcatagaggtggtaggagaggtaagcgacctggccgggcagtgcaatggcctcgaatgggctgtcatagtcactgcttacccacccatgaagacgccttgctacagactcacaggctgtttggccttgaagttagggatcctctagttgagtctcctgtctgagaaaatggctttccccagaggaatgcccccaagccagctgagttcatacctggggccattggaaagcattgtctctaacacagcttactaaatacctccgaatttccaacgcagtgccaccaagtttctcttctacttgaattgagcatagactctgggcatccagagtgacccagatccatctttagagcatggatttagtattcattgtgggggacgctgtggatttagagggcaaaaaaaggagtgacatttcttagaagacctagtatgtggcagatgtgacaagattctttaagcattagcccatttcctcagcccacacggtttattgtgcgggatgaggaaggaggatcaagagaccctagaagacgcagggctgatggccaagcctggtccctgtgactggagaccctcactcttcctgctgtaccacattctcttattcctgctagtgaaatgtccctccagattccctcaggcctaggggatcctgggtttcaggcttagaaccttatcattcattctgattcaacagttgtatctatatctagaaacacagttttccatttgcttattgcttgctgataccctctgaccttacagaaacccacaattcatagaaaaggaagctagaagttgaggatgactttaagggagctgtcatgtgagtggaagtggcaggggtgatgctagaagccagatttcctagctctcatacataacctaatgtgaacatgtgtcagagttttatttaactcattaatgaagggatctgtaagatggtaaggctggcctgaagagaattgtgaaagagcaaagataatgactgaaaaaatttaagattgctaagttacatgcaaaactacatagtgccctacagtgcaataaaactgtaacctttgaggttatcttttctaggggacaaatcctttgcatttctgctcgtcaaaatttatttttgttactacctggcaagaatcatttgcagtgctctcagttttcaccagttgacatccacagtaacagagttgtaaactagcctcataaatagtacatagtgtgccaagcagagatacatgtccctccagaagcaattaatggggtccccagtgtggcactgggagggcatgcaggaaccccttttacctacttccgaattttggataattaacatgtcattcatccttttttacccctggtggcaagcagggcacataggagacatttattgaaagttgaatgagtgaaaaaatgaatggacaacagagaacatttatttcggtggtagaatgacaaatttcttaaggctgtaaccatggaaagaaattccagaagaaaaaataaacagatgtgactaataagaaaaatggttaagattttggtacgatttgaagctagtccagctaaggaaagagaacaataaataggaaaacatttgcaataaattatgacagaagttattatatatgtagtatgtgaaaatattaggaagctattataacaatgataaatagtagataaatttgccataaacacagatcccagacggagaaaaaagtcttaaccacaagaaaatgttccactcgactgttaattaaataaatacaaattaagacaataatgggtttttacttatgaaaatcctaagaaaatatttagtggttaagctgttggcaaggcatagaagaactggtgaatttgtatgtctgtattatgaagctatttggcaaggtatgtcaaaagctatcaatatctgaataacactttttgactcagtgatctcattcctgagaatttatccacagaaactgattaatgaaagaagaaacatgtgaaacgtgttaattacagcagtatttgtgataatgaaaaataagaaggagaattaagttgtattttccaagtagaacgttgtgaagccattaagatggtaaacacagaggtttttagatatgtatttgttatgatactttgcattgtaatgatctgttatattctaagctgagagcttttcaatggcagggacctgatttttatctatttttatatttgtggtacctagaatagtgcctgaaacctaatctgcactttaataaatgcttgctgaataagtaaatgaatcaatggaaatacaaaaagagttttttgcaaattgaacaaatcagaacacaaaattgcatacactaggataaaaccatgtaaaatatatctatatgcttgtgatcaaagactgaaagggaacaagaattgaaaatgcttctgtcatagaagataacttttcttttaatattgtaataatgcattaagaaaaaccacaagtcaagacaaggaaaatgattaatacatttctcagaaatattgcccacttttgcctgcctattggctgcagagaaactgaacgttgattgcttaaaggagaaagaggagcactcgcagagctgttactggatttgcctagaggctgataggcctttgccatcatctacaataccagcctcctttctattattcgctgccagctaaatcctgttcgtcattctggacttgcttcaaataggaaaaaggaaaaaataaccatatagtctatgatatttacataaaacaaaacgtaaaggctggccttttaatccaaagttttaaaatacgatcaaaaactccccattgttccagtttacttgttatattgcagagactgggcccttgtcactgtataatataaaatctgtccttttctcttatagtgaatgttatataaatgctaaatgtagctcctctctaattccactgatgattaaaaataaacagaaaaaagcaataaacaaaaacccctaaatcacagagagatcaaagcaagaacataatagttttgcaatactgtaggattaatctattaataaaatataacatgtattgtgtatgtatatattatatttttattgattaatagatggatttctctaattttgcaaagctgtacacacacacacacacacacacacacacacacacacacacacacacacacacacacacacacagtttctctttttgccctgacagataagccttaggaggattttgaatgtatggactagtttttttgaaagagttgaatcaagtagagaatcctaaagtcctaaaacatctgccttaatatctaattttagcttaaaatatcaaaatgaatattcattcatcatttatcaatacaatcttatgacatggggccaaggccacttccctaaatatgggtttgctggtttgagttccatctatctctgcatccatagtgcatcctctatgattcccattggtttccttctcaagttctacagccccccacccgcctccaaccccttatcttctttagttgttgccttcacaccaaatttggcaacagttttttttttttaaacattcagatcattacctttatccctcctcaccaccaactctttctcttcacacctgtatatttttgtgcaatttaaccaaatgtgtgctaccattaatgagcaaaaggcttaagcaggtttaggtagaaacaaccttgacccttagtcgggtgaacagcttgctcacctggcaggagcgagtctaccagccctgaatgctcagcctgagccagcctccaaagcgtggtttagggaaggaagggagtgctcagggcagtgtgggcatagtggagttggcaaagcaaagcacctgccaagaaagcacctgccatgcttctggctcctggctggagagtggtggttgtgctgtgaaaagaaatcatcattgtgaacctaaaggaaccagactgccaattcaaaaggaaagtagcaggctgtgaattcctggattgatatttttaaagaaatcattgtgaatacacactgggtcatttttatcctgagtggagaagacaaataaatacaggcaaagttctaattataggaagaacagagatggcgtgtgaatgagatttacaggagaaatggcatttgaaggcccctggaatttttatgcaggctttttggcttatgatgtgtttttgtcattgttgttgtttcgttttgttttttgttttttttttaaagtgcattgaagccactttgtttttctatgttatctagagcctgggaaaggagccacttttcctcttgtgttggattagcttggtcttagccagtctctcagtcgtggcccaagggatgttcaaagattcttgcttttatgtgttctttatggttactttttggggtgtttctcagtggcccccagtcaggctggcttaaagcctaacctggttttgtggcttgcaaagatgataacttccactttcaaagtacttttgcatcttccttcttgtgcccatggaatatttggtccactcagctagagttaaataggcccttgaacgtcatcaaaactttaaatcagtcagacaacttttgtgggtgtggataggcccacatcctcatgtcattttttgcccatgagaagtcaagtttattcaaaggctgatcagttaataggtgatcgaagcatactgaagttctgacctgttaagataatcgccttgctttagaagggtgtgtatctctttgcaaaaagaagataacattaatataaaatatctgcttattggaatttgataatccaaagagcttgggctgttctacaattatttctccaaataactttgaggtgaaaacctctgatttcctaatgtgcagagatggtaaaacattcatattaaggagaaggaagccgtgtttagaagagaaagttgattagatttgaatcatcagcatgcaaaacaggctgcaatcatataaaagtagcatatttgcaagtttaaaggtatttataatagatttgcatagctgtgggatttatcaaatatttcagtgcttacactctgagagaaactgtgtttattgagatttggggattgattgaacagaacctgtcccttgaaacatgctcagtctagtgagggagggcaagatatacacagctaaggtaactatcaacccaagatgttaccagagtggcaaatgatggcattgacgaacgagagaggaatttaaaaataggagtagtcacagagggtgaagaagatgctttgtagaataggtgaggtttcaactgaagatgcagatggtgagtggtatttgtgttaggtgctggaggaaggaggacatggtgttagtagagccttgctctgcattaggggaggacctgtgaaactttgggacctcccctaatgcagacctcccctaatactttaggtgtagagtatagaaagcaggtgctggtggatgcaatgaaatggggttgagatcaaagttatagtgctggccacactgaactttcaaaggagcgcctgtttaaagattcctaatctggaggtttcccaggtgaacatatccccataaccattttctcacctggaaatagcaatgggagaaaacttgaggatcttgattcatcagaaaggttatcttgctggcttgtgttaccatttgttcatattttttaattggaatgatagaaagaccttagtattggactcacttaggaatttggggacctgtggctgtttttgaaggacaggattatcaagcactgctgaaggaagtttccgaaagctctaccagaaaccctttccactctgatgaaaaatcatggatgttgctctgtcttgttgggcagttggcctaagtcttaaatagaaattgtatatgttttcttaaatgacttcccttccaattactctacagatttctcttcgagggccgcctctcatgtagaatagccttgttctcagaagagtgaggggagggaatgaaaatcagcttccctatgtgaatggaatgttctggcccagccagaaagaggtaatcatacaatgaactacacaagaattaggggaaaatattggtccagccatttaggacctagataatgcttgtttatatttggcatagccagctttcccacatcctctgagattgaaaatagtgtaggtgtttatgccttcaggaaatgccccccttaaagatatatttttttttcaccagttctactgatagaaaaacatgtttaccagaaataatttgtattattttcagcgatatttaaaaagttaaattatgtctcagcacatttatatgaagttctagaagaagtaaaatgaatcaaaggtgatagaaatcagattaatgattgcttggaggtggattgactaggaaggggcacagggaactttctggagtgatggaaatgctttttatgttaatagaggtgttggctacaatgggcgtttgtcaaaactaatcagcttgtattgttaagttctgcatttatgtaaattatacttcaattttaaaaaagctttaaaagctgtcttaacatttttttagcgttttaaaaattctcaaaacacctttcccaagtaagagaaaggaacagtattacaattttcatttagttactcctgaaaaaaaaatttgaggaaaattttagcagctttaaggtgtgggcctttccttagactttgatgtgtcacttttcttttatgggaagaatggtaaaacaactcttgaaacaatgaagctgacttcgtttgtctgggtgcatccccctaaccccaggcttccctcaaacccacccctccagtgtgcttctgactggggtttgggtatcaaagtattcactggatgaaaaaaagctatagtcatccttagatgaactttttctgtcttgctacttgtgcccttgggtagactgtagacctgataaagcctccataccccttctcagtccagttgacaggtaaaacttcaggggtgataaataggaactggcctgaatagccaagcactcacagggagcacgccatcttttcagtcacagacttcctctttagtgccttacaaatggggtgcaagaaggggtggggatgggagtattgaagttcacccaggtgtttgcccaatctccaacagggttaagatttaaaaactacttccttggaccctgaacccacttagatgctgttgattgtaaagacatgaaaattgcaaggccctcagatagaaactgttgaagtggttttattccatcgttctcaaacgctaccaggtgtaagctgctctgctcccagctctgggccaaaggtgagattcactcttggggcacggtgaaattgtatcttagcacatttatgtgaagttctagaagaggcaaaactaatcaaagggctccagagctgactgggttggtcgtagagggacacaggtgggatttgttctcagcctagagccaaggcctgcagaagactgtttatgagtggggaacggcatctgcccccttttattattgtcctttccttggggtggaagttataagcccttggtgtggtattcgtaatccctactttgttacaaagagacgcatttctttcttttcttaactatagaaatgcaaacataagcaagcttgatttccaagcaggggctgttcaggctctgtaactgcctctctcttgttggaaacttctcaaggatggagtctttatctgttttgttcagcagtgaatctgtccccaggtactggggcagtgcaagataggtgcttactaaatattggtggaattgggaggaccacacagtcctgggtgtggcagtacctagttaagaacagtggcaaatatagttaggatctctcagttccttttgctcctcacaggaaggaaacctttttctgtgggggaaatcagggctctttaggcccccatggaggatttttcccaataatgtctctgccattcattcattcattcattcattcattcattcaatgtgtgaggcactgtgctttactcttagaatgagtgaatgaatgaatgaatgaaatcacatggcagtgtccgtgtcctcgtctttacacaggaagttgaactagaatatctctgaagagggatagtgtgaggtatcatttttctcttatctccagcctcagtctcgagaccaaaacagctggcctggctatagaaggaaatagtactgaacgactctcactggtactggggccacccccaccacccccatgaagggctccagctcacagaaaaatgagcatcgtgcccatggtgcacctgtgatgggaagtgtgtccccaggcgatgagcagtggttttattgtctgcccctccacttactgcgtggttaatgataggcctctgccattttcccataggccactcttctcagactgtgctgtgacagtgatactggcatctgagggtgtggtgaggtgaagatacgtctgttttcccagcagacagcctgcttttcctacacatcaggaaggcttccctcagggatcttgggcaggagccacttattactaggaataggaatgttccagacatcttcaaactaagtgggttggaattggcccagctgccccgtgctgttggggattatgccagggactgctcatttgtggttcatgcccttgattttctcctcctgctatgtgactcctgggagagagaaggacattttctggtttcttattcagtaccagcacaaaggactccactccacaaatcctgtgactattgatactgagactcatggtgaatcttcctaaccatctaagcctataaaaagctccttgaaaaaataatatgtgtcagttgagttggcatagaaacatggaatgatttcagtggaaatgctgcgaaatgccacgatttggtatcaaatagtcgttgggacagttgtgcatgaatgccgtcatctggattctctcccgaagattttgtgattgtgcaaatgtaattgccactctgtaagtctgtatcctacaagtttccttataaatgctctaaacttatcgttctggttatctccattccacaggctccatcagcaaccccctttctcatacacacctgtcccctaagtatggctgccatttcttcttctaaaagcctaccttaattttgatttcttttttctcaaagccttcctttagcaccccagatctcagtgagctcaactttgtgtaacaagtttgatgtgtgctaagtcatggtcttttctcatctgtttacattgcattgctaatgtttagtcatacctttctatcttggtagagtattcacttcttgaggagaactaaggacttgtcctatacagttctatgtcccgcagcccctagtgaagatttgtaatgcatatatacttctaacacagattgagatgctgccctaaagacgacaactgtgaagtgtgttaattattcccatcatgcagataggaataaaacggggttcattttggtaggacaaatttgcataacgtcacacaactactaagtttcaggatagaaaaaattcgaactggacttttgactcaaattttctttttcttttttgtttaaattattttagcttttacattgtatttattaatttggattggtaatacagactttcctcaacttaaaatgggattatgtcccaataaacccatcataagttgaaaatatcataagttgaaaatgtatttaatacacctaacctaccaaacagcatagctcagcctagcctaccttaaatgtgttgacaacacttccattagcctatagttgggcaaagtcatttggcaaaacagtatactgaagagtgtcggttgtttaccctcatgatcacatggctgactgggagctgaggtttacttctgctgcccagcattatagaagtatcatactacctattgctagtccagaaaaagatcaaaattcaaaatttgacgtatggttcctactgaatgcatatcacttttgcatcatcataaagtcaaaaatcctaagtcgacctattgtaaattggagactgtctgtacgtgcacatggtaaaacaattccaaaggttgtattataccacaccatacagcttgtaacttaatacttgcttgttttcaaactgcccttattttcctccaagaagccagtttgctattctgacttctgctgtactactagtggctctattacaaaatccagggccaatttttttacgcttctgtcacccatccctgctagttgatcactcaaggccagctcagacctcaaagggcctcgaatccaaatctgcctcatccattctcactgctcccccgactcagccttccctccttatccagatatcatagtctcgctgcccttcctacctacctaccccctttcggttcatcttagggtaacttagaacccttcagaaatgtacaggaagctcttacactttctgattgagttcttagcctacagataaattcttaactatatttttttaggctgtttagttagtttggtagtctggggaaaccattctcagtttttagataatgcttttaaatgcataaaataaaacgcataagattataaagggaatgatttatattgaactagttatcaaattattttaagaccaaattttgatatagtaatctatgggtatccttattaatagactaaatagcaaaggtctcccagtaggtgtaataactatcaccatttcaaagcagcaatgagcacatacgatattttgagatacccatagcatctatgatgtgatatgaaaatatctgtggtttgtttggtgatgagtcacaggtccttctaatattggtgtgttacctaccctacgttcataaccaaagcagatgccaaatttcagttagaggctaatgaaaatgaagtattaattttgtctgtttgcatttgtggatcccaggtaaacacccccttctttagcctgaatctcaaggctctatgtggtctttttttcttgttccctgttaactttaaagccattcagtctccctgtgtgggctctgcatgctacactatacatatgggaggcaaaattggaaaccaccatgtctaacctgacccatgtatctctgctcttttgtttgtatctctgcaggtagaggaaggatggtgggaaggtgttctcaacgggaagactggaatgtttccttccaacttcatcaaggagctgtcaggggagtcggatgagcttggcatttcccaggatgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattaccaaagaaaaaaaaattactggtggtgagaagtgaagtgctatgacaagatgagtgcatgccaatccccttaaaagtaggtcaagacaactgagagtccaggtcccaccttgggtggtgagcatgtgtgtccttctacgatggtgacaacgaacttcaggtctttctttctccagggcctgaaggtctccctccagcttctctgctgccctttccagctcacggagcaaaaggtcaggaccgggaaacttcgttctcccagtcactaacccaactgtgggcgtctgtgtatctcttgtgctgtcttgagccaaggtcatgggcatgaatgttgtaggaggctcgactgtgcagcactacctggggttgcagaatttcctttctgacaagaggagggcagcttagtcctgcccaaatcattcttaaatgtcttcctttttcatttggaaaaacctgacttgagtggtgttctcgtgttagtttgtgtctcatttatttaaccagtagtatgattagacaagtgtctgatttggaggtaacgccatttgcagagaagtgctcaagcgacttccttcacttggtgtctcagcagctctggatgatgtagcctgacataccgagaaacagcagcacttgctggttatccagtggcttcagcagtgctccttccctccagtgccaaagcctgggaccctactacccctgaaccccattccatcctagagtctatggtaggaagcactggaaggggttggggggggaaacgaggtgtcttggagctcctgttgccttctctggctcagggcagggggattctctattaacatggcccagctgatgagtactactgggaggggagaaggtgtccttgatctcccattagtggaaattactattgctttcaaaatccgtgttagaattctagctgccctggtgtcttctcctgtactctggaataactattgtacctggtaattagatcccataataacaatactctatgtcagggacattgtggattaaatgggattttttggagagaggaccaaattgggtcattataacattatttccatgaataaattcattacaagttccagtagcaataatgtgcataaaccaccttgctccatagcagacccataataaatggtagctctcactgttagtcaagataactgttgagacataaccagttagtatcagttgcttggaggttgcttgcatactgagcgatagcatgttggctgaggcattgtgactgcatttggaaattactttggagttcctctactgatgcagaggaggagatctggggaagtattagacaacctctttggaaaagtcttgacatattggtgtcctgccattttagctatgctctcagagctggaagatcagaggagtaatgcctcttgtatctttagaactattgaaacaaattgacttctctcattccaagtcagtaatatggacagttcaccctgtctgacccctcagctaaaggcatatggtgctgcaattcctggtacagaggattaggaggttgggcggaatggtcttcccatttagcattatgtcatcacctgctcagaaggggcattttctcttctggagactgttccccccaacacacttactgaattaaaagccttccatttcaagaccaggagagcccagtggtttcagcagccatgtttagttgccatttttgaggggattttgaatcccctggagaggcatggtcccctaacaaggatggctgcttctgataaaggatacatggcttttgtaatcttcctgcatgtacagttaaggaaaagagggcccatctctccatcggttggttcatatccatctatctatccatccttctttctctccttccttctttcttccttctattcttcattcattctgtctttattggcaccccattgttactaaaacactgtccaaggcactgacgatatacagagacaaatcagacagggtccctgctttcagtaagctcacactgcagaaaggggacatgcaaacccgagttcagcaaagtgtccaggtgctctgcaaagtaagcatctgaagaagagtggggcacaaagaggccagtcccatggggatgtggggcttcatagaagagcagatgtgagaataatgaatagcttgctaaattgaagtaattccctgaaagagagaaatagtatctctcagtgttctgacagaatttccagtagcaggccaggcatggtggcttatgcctataatcccagcactttgggaggccaagacaggtggatagcttgagcccaggagttcgagaccagcctggccatcatggtgaaaccctgtctctactaaaaacaaaaaaacaaaaattagctgggcgtgctggcacatacctgtaatcccagctacacaggaggctgaggcatgagaagtgcttgaacccgggaggcagatgttgcagtgagccatgatcacatgactgcattccagcctgggctacagaaagagactattaaaaaaaaaaaaaaatatatatatatatatacatacacacacacacacacacacacacacacacacacacacacacacacgtatgtatatatgtgtatatgtatatgtgtgtgtatatatatgtgtgtgtatatatatgtgtatatatatgtttatttggtatttgcattcttcacatttctgcttccagaaagtatttgaagtagttactgagttgaattttgtgtaccaatggatgaatatgatagaagaaacattggcattatatttataagggagtatgccaagactgcttgacacatggtaggtgtttaataaatgcttgttgaatccccttttactataaggaggcatttttatttttgaatgacaggtgaaaatcttttgaacttgcttttctcttattctgatgtatttttccatatcgtggttggttatgaaagtctctaaactttcttagatctttgtttagggtaatctagtctatcaaggaaagaattgcaacgattgtattggtggatattttatccattttatctcagagaggaaaatttatagttatgtagtagcagaaacttttcactgcatatttaaatttgaaaacatctttaccattttcagaacttatgaaaccttaaaggtagtttttcaaaaaagattcttataaacttttttattattgaaaatttctaacatcaacaaaaataataatagtataatgaacctctgtgtacctatcactcagcttcagcaattatcaacctttggccaatttgttaaaattatagccctctgcacgctttgtccatattatcttgaaggcaaaccccagatattatataatttcattcataaatattttaacatgcatcagtaaaagagtgtctttaaataccatttatctcacacacataaaattatggcaagtccttagaataattaaacacatggtcactgttcactttcccctaaagtcttctttattgcaattcatttgagtctgtatccaaataaagtacatacgttgcagttagtcagtatgtctcaaatctgtttgaatctatagatttctccttcatatctcctttttttcttgtaatttttttgctaaagcaactgagcccctttgtctattaatttctcacagcgtggcttttgccgatttcatctctgctgtgtcattaaatctgtattcctataaattgatcattagatctggggtcttgattagattagatataaatataaagcctgaaaatatatatatatatatataaacctgaatatatatataaaacctgaaaatatatatatatatatataatctcaaaagatatatatatatatagagagagagagagagagagagagagagagagcgacagagattgagtgcgcatgcgtgcgtgcgtgcgagagtaaacctgccacctaggtggtgatggataatccacttggaggctcataatgtctggccgtcctactttttgaatgttagcagccattgataattgtctcccaaacctagttactcattaggacttgcaaagaggtttcaaccagaaatttaaaaataataataaaatgggctcccatgtaacagatcaatagtccaaaaaagtgtttagtaaattaggtttttaaaaatcaaaacagccaagtggttgtgctaatagtgtaggcagaatcttatgatgttaaggtggaaaggaatttagatattgtttaactcagtgtcagatgagaacactgaagcccagtgaaattaactcccaggcttctgagtgatggggagaaaatgacatgcaagccttccatacacattctggtgctgcctccattacacaaatagtttacctttccacaggtcatctgacaaatttcaagcctgagtacagtttagcttatttcttcttattgtcacggatcatgattagttaattgccttttcagttacagttttgcacatgctactgttgactaaataatgtgcagtggcaaagaaatccagatacgactgttgtccaatttcaatttcatacatattttgccttacatttaagacataaatatgtcttttctttcacatcctttgatattatttgctttcaaataatagttgtaaaactaaaagtgtccctgttttttaattctatagctacagaaacattttcagttatttctcacaatcttcagagggagaaagtttgcattttctttctgtaaccattaataaccatgagttttctgttgttattgaatttctcattttcctaattccttatttaaaaagttgaggttctgataatttagtgacttgtcaggctaagacaaagatgaagatggaggccaggtgtggtggctcacacctgtaaccccagcactttgggaggctgaggtgggaggatcacttgaacccaggagtttgagaccggcctaggcaacatggtgaaaccccatctctacaaaaaatagaaattagctagctatggtggcatctgcctgtggtcccagatactcaggaggctgaggaaggaggattgcttgaacccaggaggtcgaggctgcagtgaactatgattgtgccattgcactcgagcctgggcgacagagcaagaccctgtctcaaaaaaaaaaaaaaaaagagagagagagagagagagagaaagatggtttttaaaaatgtatagcaaaccactgccatgatgcagaaataattgtgtttcattagctgtaagaaatggattgctcagcgtcccttgcatataaaaatgagagccagtctgacaaatcccactctgtggcatcattagactttttttctttttaatattagatgatatttgtttggagtatgatggtctattagcaatgaagaacgatgagcaaattgatgtgatagtttcaggcaaaattagatgctagcataagtgtatagttttgtgtgtaaattttaaaactcttcccttttatagtgtttgctgccttcaagtactaatatttaacagtgacagtatactatttcccccagtaagatcaacgtcactcatattcataacctttccagttggctgcctcttttgctcttcacacaggacacctatgtgtcctcacccagccccagcccagactacatctcaaattgccttgctgccaatgcacagagagactttgcaggaaggcttaaccattcagagacatcagagccatggtctacctcagtgactctcaggcttggtgttagggaagaacacatggaagttttagtgtacttaaaggaacattatcgaaatactgcctttaaaaaaaatcttacacttcctttttttctgacacttgagaggactgctgttgttaacttttggagggcctagctcacaaaacagctgtgttctgaggagtaatggtgacttaatgactgaagttaagcagaattgcccgaataaaaactagccactattacttgctgcacttttgtcatcaaagtcctcaagagcttcaaatctagcaagaacatttgaaactttgttagtcttcagattattcttacacagccagtgatttgaatgcctaagtttttgctttaattggatagaatgcatcggtcaaaaagggcacatttcaaaaggagggtataccaccatggctgtaggacacggaaattggaaatacctgatcccatttaagttgttggtcttctgatgattcacaattcctttcctatatggggagtgccaaggcccagaagctgacagtgtggtttctcttgggtttcccattttaacatggagtgtttctaagaagtgagacaagttgctctctcccttcacttagttctactccctgcttctctgtaaatgtagcctagctttttcatcctccagacttattaggaagctgtatgactggcctccagtttgaatatttaattaacaagccataataaaatttatttctcagataatttaaagtaatatgtttattaattgagtttgcctttagcaaatcattttgcctgtcggtggtactctctgtagggcatttgtgtgtgtgcgtgtatgtgggtgtgtgtgtgggtgggtgtgggagggtgggaggatgggttggagtacactcaaaccagggcagtatgtgtgtattctgtatagttgctcatggttccagagatatttgggctttagccaagtgttcagccttatgctattgacaatctctacctgtaacagcaaaaaaagataatttgacatttgacactgggtgagtcctgtgtcctcatgcttaagtacagtttcatgactgacacagcagaatcccaattaagatgttttgagaaatagggttttctggtgtccttggttctaagcagaaaaccccgtatgtttatgtggatgccactgttggtttcaaacctcagtggtgaaacccccctcaccagtatattaatacattttcttgcttaaaggtactgagggtgacagatcttttaaagagaattctgtgtcttgtttagaatcttggggacatgaatattcgtttttatcatgtaggtctctaggggtagaagataaaggataatgtgtctaaatctgtattatgcataggtcgtattctccaaagagaagcttgtgctgtacaattgagttaattaaggagtccaattgattggattccctctggttaattgaagttttcctattctttaagttacaatgttgaaagggcttccaggtttaaactgggcataatgtacatgccagtcatttgcagaggcaagccccaatttctgggtgcttatgccatactggttgcatggggactttgggctcattctgtaacattcttaaatcctgcctaatggtctctacttaattttgtggatgaagctcttgcagcagattcattgaaggcaagttcagttaaagactcttcctcttccttcttttgccatcatttgctccctcctcccccctctcttgtttttctctccccttctcttctctcattcactgtcaggaaagactacctttgaagggacaattctgtaccgagctgcaccgggaaagacggagggccacagacgctattacagtgagtgaccttaacagcagaaggcaattgtaaagataagatctgggtacttgtgttttttgatgcagctgccctttcctgagctgctcatgcttatgccaagtgtctgtgtgaatttctgatccaaggacatggacttatttgtctaagtaagtgccatctccttggtgtgtgctaagaagcattcccagcaccagcccctggcgcttttgtttgctttctgcctctatcatgtatgtgatatgcgtgcatgagccatacgtgcaaacaaaggagcagtagcatttgtcgtggcatatgtatttgtaccagtttctctgggcttctggggtggtgtaagatggcttcctgcagagatgtcaacctctcatggttattgctttctctgagtgggtcactggaaaccaataaaccattttgtcattgtgtggttcaaagaagtaagaatttggcatgaaagtccatgccagaaatggcattttgctttgctcactcagccaatcaccacatggcagactttttttggcaggaccaatgtgtagccttttgtgttgtgaaataaggctgccaaaagttgaggggaaggagatgaatgagatgcccttagaacagttcttgccacacagtgagctccatccatgtgagtgttaaattaaaaatagataaaaatatctcatggatctcaactgatcaatgctggaagactgggtacattccacaaaattggacagttaaaggactctcagaaacaaaactgaggaggctttgttcttttttttcaccttgaaggaaaagcatccacctttgtgtgcatatacacatatgcatacatacctacgtgtatggatatgatgagagagaacgttgaaacatgaacaccagagccatgcttcacaaactggggtcaagttttttttccttgccactccaccatgggaagatgcatggccctactgcacatgacctcactacacatgcagggtgccgcctgtgcctcaccgtgggagttttgacagcacctagattgctctgtgccctggtcatttagatgactccaccaccagccacatgtctggaagttacaccagtgcacactgttaaaacactaaagcatcgccccagacaccacactttctgtagttctctcaccactgcctacctgtaatgagcccttcatgaaccagcccccgtccacagtccacactctgggttgcaccacccaagagtgtaacctggcattctgggcctgacatggggacattttatgggataatgtgcatgatgggcacgagtcactaaaagatatatcactaaatgaacatgaaaatgaaaagtcacctttctttccctctaaagggaaggaactagattttgaattattttaccaacacagatagttagatatttaatttatacacttaaaagtgatagaaccagcctgccagaagttctggaagaaaaatctgctgtgtgtttccttcccgggccatgcttgtgtggttgaatgactgtgcaacctctctctgtgtaacgtagagtatttctcacggtgattagtataaacatattaagatgagcccagaagacagtaaatcccaaaaaccagaagctcagtgaaatgaggatggcagtggctgaaaatattatggttctagctaatggtgaatgatagaagaacccttgaaattcttctctttgaaaaactaaaatagacttgccctaatctgtttgccctgctgccttctggtggtgatgaggggagcgtgctgagggaggggagtggtgatggtttctttccactaatggtttctttatttcacccttgaatggctctttccaagccagaaaggaatatacaagtcatttatcacatagaaagaatccatacggcaaaatgagaacatgttaagggggaaatgacacaatatttagactccaaaattatatctccagcagggatatttgcaaaaacaatgaacagataaacacacaaatggatagatggatagctaatgggggagggttcttgatgtttacacactctaatccttcctgtgaattgcagccgacccccttgttgtgggctgttccccattcggtcctgtgtttttgctcacaaatgctggttttcagttaattaaaatgtacactggggaccttcctcctcccccacccttttggcttaaaaataccattttatggaaaatgacaacaacaacaaacaaaaccattgttttaaggatttgattctgaaacgtgttagcagtttataatgacctttctatattttgtctgttttcatttaacagtttcttcctgcactgagacttccttatttgaatgacttccacattttatgagattttatgtgagcaagtatttggtgtatcattcttatggactaggaggccaccttacctgtaggaagataatgcacaattggctaatagagaacaacatttgatggcgtactttcatttcaagggcatggttatgatcaggagttatgtagtaaatgttcaggagctattctacacatctagaggctttcagagacaggttaatgacagagtttagtattccataaaatattctttgaatcctgccctttgatggcataattgatatactgaccatcaaaggaagaatacacccagaaattaactagacacaaataggctcttccttttaggaacatgattgtgggcagagccttgggaaaaaagaatctggggaggtaagtgtccatgttgtcttgctaataactattttatgacttccaaacacatgccacagaagatcaaaggaagagtgtcatgtccccagtgttcttctttggaaagggattcagctttgggaaaacactggtgtttaaaggagagaagaagggctgtaggtttgggggattctggcctctgggaggacggcttcctttccctctttaacaaacatgatcgtcttgctagtgaaaccgtcttaatgtcaagtttggtttaatgctttcctagagaaacatgtctgcatgcatttattccttgtgaagccatccaaaaagattgaattctttggcagttataattttgtgtggtttctttaattgctcatttgtttaaatggcttttagctttacagtttccctttaggaaatgttactttcattgctaattgctaattgacatgagtcatagagattggaggtacagtatgtggtactgactgggtggggaggcaacaaggtgggtgggaagggttgctattgcacaggctatgggaaaacaaatttggatcaaaaccaggctcccggctaaagaggggtgaatttcacatgtacaaagatatctgctttggaattagattttctgaaaagttgttttgattcacatcttaaaattaaaagtaaggggtggggagatcaaacaaaactcagagccagtcaaactactcaacatactgaatacaaaagcctagtgcaagttatcctgtgcccagtcacacttttagaggtggttcctggctggttgtgaagttcttcttcagggctctggctgatttctgagctctttctctccccatccccactcttgacaggtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaaggtatgttcgacagtttctatttgatttcaacttaatgtggaatatccaaaagtacgttgtggggtttggtgctggaggcttccaattcctcttttagggtttccatgtcctcatgtactagttgtttgtcctgtcttcttttttagctctccctctgtgtgggaacgacttccctcaaaaggctcatgctctagtttgctgctttctttcttgctgatctctctagggaatgcttctcaggatgactttggaaatggaccagtacttctctatctgcttcccagaaaaacccctcattcctggacccgcctaagtgcatgaccctgacacttttcagacactggccaatctctctccgctccttgtacatttctctagtgctttgtgcttgggtgtgctgactgtggttctgcactagagtgaaggaattgtgcaccttttctctaagagttagttggagataatttcagactgttgaaaggaagtctcccgcaggtgtgaatgatggagatggcctgtgctgtgactccctgggttgttcccttcaggaagctggctgtttccttctgcctctggttctgggctagtgagaggcaggcagcatgttgctgctgagtacgcggttaccacagcaacacacccagagccctcgcgcttgtggctgccgatgacgtctactgtggtatacttctgagcattgtagccttgcttaggagttgataaatactgtggaattttccaaattataataagctactctcgtgctgtgcttaaggcatgtttgttaattcgatttagtgctgaaatttttgctttgacatttgtgccagcagatttgggggacggggtattggcaacctctctaattcaggtttatgggtggcttttaagtgttgttgtttttttttctttctttttttttttttttggtgggataacattttaaaggttgcatcatcttctgcagctgtaggacatccacccctccacccgccctcagcaaccttgcccagtgtcatcatgcattagaagcagaatctgaaaaggaaacttttcgaacactgaatccctctagagatgagtcaggcagaaagggcagatacctagaaattaaaaaccgtttcatttaaactttttttttcaatgttgaagtttctttgagtcagcattgttcctttcagcaatcaatatatgatatttttcaagatctgaaaactagtgtcccagctcttgagctcacttctgttgcatatggtcacattcagattcctgtgaacatttacaaaagagcaagtccccatcttggaaaggaacactggatgcagtttttcttcttttattcaagtggttgaagtgaaaacgaccattgactcagtcagcaaacagttcattccttttgtttgttttatgattcctggcctttatcttctttgtgtaggaggactgtgtgtgtgtgtgtgtgtgtgtgtgtgtgtgtgtgtgtgtgtgtatgactcttattattgctattaatattagttttagctgccaataataaattgagttactgttgatagcaatgtcaatgtcaaatataatacttgaaagtttttatctcagcacatttctttcctgaacctcagagctgtatgtccaactgcctgcttacttcagtatctccacttgaagatcttaaattcatatccgtttgcctaaacctgaactcatcgtcctcctccaactgctctacccacagctttccccatctcagttgaaggcagcgccatctcccactcctatcgctcaggacagaaaccctcaggttgtccctggctctttctctcagctctgcctcctaaatatgtccatcatccacctaggtctcatcacttccactgctccttaatagggatttctgcctctccccatccccctggagtttagtcttaagagcgaagccagggagaacctttgaaaacccaagtcacatcatgctactcatctgctcacacccctaccaaggctttcctgagaaaaaaagtgagacccgaccctcgttactgctgggacttcctcccccactgctctcccttcactttcttcgttctgggtccttgctcttcctcagacatgccatgcacactcctacagggggcatttgctgcaatggtctcctcagcctgggccactctgcatctacctgcccacttggctgcctccctttcctccctgctatcttagcagaaacctcaccccatcccccttcctggtactaaatattttgttctctgtggcacataccatcttctaacagatttatttttgttatatatgtcacttattttgtttgctaatctattctatgtgcttagaacagtgcatggcacattgtaggtgctcaataaatattgttgaatgaataatattaaaatataaatgctgcactttagagattacagacatctctagaatgagagtattgggtgagataatatagcacttgtgtagttgaaaatatatcaattgtatagttcactgcacctctgtgaagcagatagttcatttattgcattgatattggtgccatgaagtgttaacttcatcagacacatatatgtgtgtgcgcaagtgcgttgaacatccctaatccaaaatccaaaatgctacaaaatcgaaacttattgggcaccaatatgattctcaaagtaaatgttcatcggagcattttggatttcggatttttggattagggatgctcaacctggatgcattctgctgatactccacaatgcaaaaagaaaaaaaaaaatctgaaatccaaaacacttctggtcccaagcatttcagatagggatatttgacatttgtgtgtgtgtacgcattcgtgtatgcatcttgattcctgatttgtctgcagaatgaaaccatgtgctggaagctccctaaacccatttctcatgtggagcctctggggaaaacataaacttcctagcctgctttctgggtgtggacaatttttacaacatctaagaggatttgaaactatctccaccccatgttgttggcgccatggatagttgcatagatttatggatctatcatgttattgtacaacctggcacaaaagccgataagtgtgattctgttttattagcatacaacctggttttcatcacttttgagatggttatgtgtctaagatttatgtctaaggaagaaagcttcctttgagaattgagctcactgttttcatttttagaagtgtaaattggatcttgcgtgatagcattcagtaggtgaggctcaagtaggtctgctcaggctgcgacagttggccttctgaaatgtctggcttgataacttggatgagggaaaaagggaatctgaccattattaacagctgtgagcatcatattatacttttcgttcaggtttgtgaagttttttttttttttttttttttgaaacaagagtcttgctctgttgcctaggctggagtgcagtggcacaatcttggctcacagcaacctctgcctcccaggttcaagtgattctcatgcctcagtctcctaagtagctgggattacaggtgcacaccaccacacccagcttaatttttttttgtatttttagtagagacggggtttcaccacgttgaccaggctggtcttgaactcctgacctcaagtgatccgcccaccttggcctcccaaagtgctgggattacaggtttgagccaccatacctggccaagtttgtgaaatattaagatccacttgtctgagtcagtagataatcttgtgcttatcttatattttaatctatattaccctacccagagttaatgattagattatacaccaggagagatattgtataacatccctccaccaactgtgaatagataaatagttcatgtaggtattcttgtttctcttatcaggctataaggaaggattccgtttatgaatcttttaaataccaccaagtggatatgtctccgaatgatttgctgaatgtaccatttaactgaaatatttacagctgagttgatttaatgtctgggacttgcttcctatagtccagaagatgaaagagtggggcatagaggagacattgatcatgagttggtatttgttgaaactggatggtgtatacatgggggttcatcacactctatttttgtgtatgttggaaatttcccttgataaaaggttaaaggggggtggggaagaaccttggagaaacatgtaccatttaaaccaagctcagatgtaagtatgtgctgtatcaaaataatggaaaatgctatatggctatagatgaaccaggttacaccttagaaaatcatagggccatagtaccttcatcctagctgattgacctcgatgaagttggcctcagctgggccatctgtaaaatgggaatacttttttttacctatcttacctcacaggacttaaaaaatatatacctgaaaatactttctaaatatgactcatttcaactagcatgtattgagtgctcactaaatatgctcagtactgaggatacagtcgtgagggagaccaggtcactgccctcagggagctacagaaaagtaaataaacaataataatagagtataggaaatgccataatcaggctgagaacacagtgttgtgctgtaggagccctcaggcatggcaggaagtggtaagttgttagggaggctggaaggtgtgtgtccgttcatgtgtgtgtgtaccagcttcctacaggaagtgatgtttaggctgaaaaccatgggtccagtaggcgtagagttattaaggtagggagagcaatatctataaatgccctgaagagggaaagagatagcacagatgatgtgtagaggctccagcaggaagcggggaaagaagcagggcccagatcatgaagagtcttgtgagactcgttagggagttggacttgatcttgagagcaatgggaaactatcaaagtgttttaagcaagagagtgacacgatcagataggtggtttagcgaaagtattccaactgcagtgtggggagtggattacagaagacagggtgagtaaaattcagaagagaggtaacagaaacatactggctttcctgataaatagccccccactccaaatctaggttctaaaccagttaattaattagatgagtgagtgaatggataatcaaaatattttgctgatttttttttcattatagatatccagttgacccagcactgtttattgaaaagattatcctttctacactgcacagccctatcaccttagtcataacctaagtggctatatataagtgggcctatttctggactctgttctgttggtctttttttccttgtgcccattctatgctgcctatgtattcctcttcaagattacctaagctgttcttggccctttgcattttaatttaaattttagaatcagtttgtcaatcccccatcatcataaaaaaaaaaaaaaacctcctggaattttgattgagattgcattgaatctatagacacttttgatgacaattggtacctttctaattcatgaacatggtatatccctctatttgtatagattatgttttattttgtgaaatgttctcaagctgaacacttatgatttgtgatctctctgtgcatacgttttatttcagtgtcattactgatgaaggcaaagttggaaggtatagattagtgtgagaggcaaatgggcctgccagctgattcccagaattagacagatttgcccacacaatctcagcaacattggactaactcaggccaatgtgagatagaaagacctgccccttgaggaacagcagagaaggctgacttccaagaggaggaaagagaagagctaagctgagcacgcccagtatatttttcttaaattcacctatcagataagtaatttcactctcccagggaaggaaacataaaggggaagagaacggcaggagtgtctaattgtgtccagagagtgtccatttgaatttctttacatagaaggggacatcaaggtaagggatgtattaacagcttgaactattgtcatggagagaaatggatggtttggggaaatattttgaagatagaatcaagtttgatagtatgtgggggataaagaagagggaggacttgaagattgtgccttcggcaactggcttaagcagctgagtactattttctgattagaaaacagtggagagagaagatatttggggaggaaggacatgggttagactagctggatttggaagttcttgtgggactgtatcaagtagagacatccagcaggcagatggatacataagtctggtgattgggagagaactgtaaatgtaggtttcagagtcatcagcctagagattgggctggaagactctgagcaagaaggcaagcccagacgagactgtattctcatgaatacaggtggtacctctgtctcccacctgtggacctgagagggaatttcttcatcaggctattttcctgtgaccccagtctggccctactctctgtttctaaactccttccctttttatgagtcacttagatgatcacttctgaccaaccacttagggaaaggagtgtcaggtattacacatggataggtaagttacagatactcgagtgagtctcaggacctaacctgacatggctttatatagaataatgctgggtttttggtgccagctcattccgtgtcctagctctttaggcactaccagtcttggcccacttaattattggaaaaagtagtcttttttgccttactggaaagatttctaaactgaatggtttgccaggttggttgtttactggattccctgcggagaaatctttcaagaagcttctttcccatggtcttcctgtcttagctgatttccgttagtgacttctgacatctctctcttgaattctgtctacactttctacaaggcgttgtgtttgtaacagcctctttttcaactcttgtcatcttgaatctcatttatagaattatagtcacccaaattaatgcctttatggtatccacattgtagcttttacttgggacagataattagaattaaaattgtgtataaatgagagtgactaatcaagtttttaattagccaaattacagtaagagaatttaagtattttcatacgtatctcaggtagtctttttttttgtatttaatttttgtgggtacataataggtgtatttatgtggcacatgagatgttttgatacaggcatgcactgtgaaataagcacatcatggagaatggggtatccatcccctcaagcatttatccgttgagttataaacaataaaattatactctttaagttattttaaaatgtgcaattattattgactatagtaatcctgttgtgctaccaaacagtaggtcttattcattctttctattttttatgtacgcattaaccatccccgcctcccacccagcccccacccaggtagtctttttatccattctagtaaaaatttattaagctgcataatcatataaaattaaaacatgtcaataaggtgatgatcttagttccttaaaaatgagagatctatgtcctaatcctttgaagactagaaataagctctagagaactccagaagctaatgagatatatactctttgactaattaaacacaagggtcaaaaccttgttgtgattatctgagacctagagtattggctgtccctcgttttggttgaaaaataagattgtgtctcttgagttgttggaaaacctgtggtttttaatgagcagatggtattaagatgcccactggttgcctgggttgaatgaagtgtttgggattttcagactttggcttctctctcctcagagtgtctcagttttgtttcctgatctggaaaaagtaaggaaggaggaggggagttggtagggaaagggaaacagaaacagtgaaccagtattacaggattattctttgtcatgttgggtgctgctttctgttttatatatgtttgatgtgaactttctaaaacactcagcctagcgtattttctaagaaatatttagttgcagccagattgtcaccaagaatcatattcccagaaggttttcaaattgtgttaagagtatagtggttggccgggtgtggtggctcacgcctataatcccagccaaggcaggtggatcatgagttcaggaaatggagaccatcctggctaacactgtgaaacccagtctctactaaaaattcaaaaaattagctgggcatggtagcatgcgcctgtagtcccagctacttggaagcctgaggcaggagaatcgcttgaacccgggaggtggaggttgcaatgagctgagattgcgccactgtactccagcctgggcgacagagcgagactctggaaaaaaaaaaaaaaaagtatagtggttattaaacatggaggacagatagcccaggttcagacttcaactctgcctcttcctgggacaagttacttaaccactcagtgcttttgattcctcatctgtaaaattagagtaacaagagaatctaccccagagggttgttgtgaggattaagtaacatgtaatggttagagaagtgcctggcacatagtaatcacttgattaacgttagttattattattgttgtccttattgttattagagtagaaagagtacctataaatgacagtacattttccagggttatttctatttatttatttatttatttatttatttatttgaggcagggtcttgctctgtcacccaggctggagtgcagtggcatgatcttggctcactgcaacctctgcctcccgggttcaagcaattcttctgcctcagcctcccgagtagctgggattataggtgtgggccaccacgcccggctgatttttgtatttttagtagagacggggtttcaccatgttggccaggctggtcttgaactcctgacctccggtgatccacctccctcagccttccaaagtgctgggattacaggcatgagccaccatgcctggcctctttaattttttattatggcaaatttcaaactgcaagaagtacaattgaattttgctatatctgtgttagctgtttgtttcatatcaccaagtcttaaatgtcagccactagaaagtaagtgccataatttgggaccttgtctgtgttagtcaccatttacagtttatgaaaatagttgtcaaatgatagttggccctcagtaaatatttgtggactggatgaatgaagatactgttttgtgctaatccaattctggttgggatctgcttgtggtctagctaagattcactcttccatttgttcattaattcactcattcattcattcactgaagctttattgaatgccttttatggatcagcagtgtgaagctttattgaatgccttttatggattagcagtggtatctctgggatttgtatgtaaatgaacaaaggggtggcaatccatttggaaagggattggctaaatggcatgtctagatgttgtatttgcatagtaagtgcggtttttttttaacctgacaggttatttatttggggtggagcagatctggtgtggttcatcggaatggagttaacacctcctaccctaagtcacaccttggatcagctgtcatatacaggtttctcatttaatgctttggattgtccctacattggagagaaagggggtatgtataaaagtcattataatgtaaggggaaagactagcagacgcatgtccaaagcatcaatgagaatagaaaggaagaaactactaactttcctccaggtcaagaaggaagggatgggatatccttggtctctttttaaggaatgtggtatttgagcaaggtgttaaaagacgttgggaattcatggtactagcagtgtgcatgtggacaaggagtgagcatgagtatgttgaaggaagaggtgggttgggctggggtgcaggggctgtggtggtggtagtggaggaagtgggcagctgaaggggaggtggtgcctcttcctgcagggctctgccagcccactcacaagctgcccttcttctgggtgggtgggcaagttggtgaaggagttcagttgggcagcagcatgatcagatttatactttagagagataactggggaggtgctgaggaatgtggactggagatgggagaggaagtagctgggagacttgccagccccggggctccatggtcgatgactaattggccaggcaccaggaacttctagtagctcttggaaaggggcagatgggcccacctcatgcacactctttaagctggatcgccgttgcctgggttggcagcaacactgacaaaagagccaagtttcctttcaaagaaaattcttttgtgtattttgggaatgaaaaagccaggagtcagcattctactatcttcattaatagataggctaagaagatagagacaatttttaaatttgaagttgagagggccttgttaaatagatttacatagatatacacatgggcataaacatgtatagctataaatcacagatatgtgtttatttatatatacctttgcattcagcaggtttatctttctaattagttttttaatcaacttttaattttagagtagttttagatttatggaaaagttgtgaagataatagagttcccacatacctcacacccggcttcctctcttgttaacgtcttgcattaacgtggtacgtttcatattatctttttttttttttttttttttgagacagaatcttgctctgttgcccaggctggagtgcagtggcgccatctcggctcactgcaacctccgccccccacccccacccgattcaagcaattcttctgcctcagcctcctgagtagctgggattacaggcacctgccaccaggcctggctaatttttgtatttttagtagagacgaggtttcaccatgttggccaggctggtcttgaactcctgacctcaagtaatccgcacaccttggcctcccaaagtgctaggattacaggcgtgagccaccatgcctggcccatattatcattattgactaacatccatgctttattcagatgtcctcagtttttatccagtgtcctttttctgttgcaggatcccatccagaataccacatttagttttctcatcttgttaggctttaacagtttcccagactttctttatttttgatgaccatggcaattttcagttttgtagaatgtccttaaataagcatttgtctgaagttattctcatgagtagattggagtcgtgggtttttgggaggaaggccacagaggtgaagtgctctcattacatcatattaattccatacttatcgctatagatgttaaccttagtcaccttggctgacgtaggtgttagtcaggtttctccgctcgaaagttctggttttttccctctttccatacttgactctttggaaaaagggtactctgtgcccctcccacttaaagagtggggagtttcattctacctccttgagggaggagtatctaaagaaatgatttggaatccttctacacaggagatttgtttattctcctccgtcctagttgggttttgataagggaattttttttatctgttctctgaattccaaatgctaattctgtagcacttgtattatatttgtcatttactacctagtgacatcacctacatttgtgtgtgtgtgtgataagtaaacagatttatgtcttatttacccaaggagattgtaaatttcttgaggactgggacagcatcttatttaaagccccttacagagttagatacagtgcaggcagttaataaatagtaagcaaatggtttttaaattagtttaattaaaaatttaaatattaaccatagttaactgaaacaggtcatcaaagtctaagcatatgagaaatgtggtaagataaggatactgtttacttggcatcctgatttgtgaaattgtcctgaacttgtaattgtggctaatatgatatttactgtgtgccaagcacttttgtaagtactttacatatattatttaattttccagacagccctgtaggttggtgccattatccccattttatagataaggaaactgagatgaacaaaggttgaataagttgttcaggatcacaaagccaggaagtagctcaactgggattttgatctcaaacactccggctccagagttttgaacacttaaccactgcgctctagattcattgaagtggtgattaaaatggtatctcttttgggggaaagaacaaaattgtgatttaaatatttcatttcaacctgttaggatgctcctgatgacatggcagcaatgttgctgtatttttcctagggggagtatttccataaagccacggctgtttttccttcttctgtgtgtgtgtgtgtgtatgtgtgtgtgtgtgtgtgtgtgtgtttatgagtaatttttgtgtagtgcaactaattgcatttaaaatacaggcatgttcatgattgatatgtcatatacagactatattctagatatccctcactctctagccatgtgatctgttgaaagatagtgggctttttatttcttctctggcatttttaaacagacgtgatcactaggtcttgccaaataaacactccctcagtgtgttccttgtccgaatggtcacacctgggggccccaggagggagcccagattgcagcagcaacataggcgagggaggaggacttctctcgaagccacccaagccatgaattggccctggcttcctgaaccataaacaaatgcgagctttgttctccccattcctcatttggtcccaagtatgactcagggttaggctgggtcctcaggctccgtgctgttggaaggaagtgggaggattccaggggagttctgggaccttttcaaactgaagagaggaggctggctgcatcatgggagaagaggtatttctttttttttttttttgcttttagagttgtaataaatccagttaacctgtatcttatctgtatataacattttgtagcaagactgggtaatgggtttgcattagtgggttgaaacaatgtgtgtgccagctaggatcccacagaggggagctatggataagctgaggaggaacctatcaagtatacggattatttgctaaagctgaatgtcactctggagctatttagccgttttaatccctcccactttggtcaatttggccattaatttttacagatgtttccaatctctctgtgtcttgggttttcatgtgctcatattgcagagagaaatttagatgggcagtttgcacaagcggtaactgttacaccatgtcacagagatgtttagcaattacagatgtttgtgcagtaaacaaatccagcttgcttttcaggttagcttagagagaagggtatgtccatgcagagcaagccagctgtggggcgtttcactcttgagggtcaccgacatttggagttttctttgtgagtggagcagctgtgagtagtgacttctgggtgctattgaactgctttttttatgatggggtaaagatatttggctagttttgtagtgcggggcatttataggtatgtactcatgtatggagaaaaattaagacactaaattattttgattttataaaagtttgctagaaataagtggtcttgtttttctctgtgagttgttcatatttgtctacctaaaagcagaagtctgtcattttccaaacacaaaattccctaaataaaccacaggataagtaaggcttacagtgtgtcatatgtcttccatatccctgtctctcattgaaaaaaaaattttaaggggagaattgatgaggtctgtaaaatatgtccctttatgtctttttctgttggctttaacttatactattttcaaaattacaaaaaaaaaaaaatagcgtggccaaaaggaaacacattgttttaacatatcattttaagagtaggggaacttcttgaaaggtttttaaatggcatctgttgcttgcctagaaaggaggacagaggcagatatatgaggagagtgccgttaggggttggctaggataaaaatatattcatcggcaatggcttgagaggattttcctagggaaagatagcttatgtttgctgatcttatgctggatgtctttgttctgagttctgatgagtagaaatctgaatgaggtatttatatgcaaaataaagatggtgaatcttcttccttggggaaatgagtgaaagcatgattgattgtaaggtgtgaaaaacgtgggaaagtctcagcagctagggcctggagatgggagaggaatggtagcccctggggggcctgacaggttttgccttggtcctgtgatgtctgagctacttgttgcactggtaagtgctccctgaaccctttgcttgtttgtttctcaaaatggaggtagctctgttacttctctcattacaagagctctttgtaataataataataattattattattattattattcaaagttgaagaatacaaagaaataaatagaaatcatcctcagctgagtgcagtggctaatgcttgtaatcccagcactttgggaggctgaggcagttggatcacttgaggtcaggagtttgagactagcctcggcaacatggcaaaaccccaactctacgaaaaatacaaaaattagctgggtgtggtggcatgcacacctgtagtccccagctactcgggaggctgaggtgggaggatcgcctgagcccgggaggttgaggctgcagtgagctgagatcgtgtcactgcactccagcctgggtgacagagtgacagcctgtctcaaaaaatatatatatatatatatatatatatatatatatatatattaccctcaatcctatcattcaggaacaaccatagttaacattttatatgtatccttccagacttttttttttttttttttttgagacacagtctcaccctgtcgcccaggctggctggagtgcagtgacgtaatcttggctcactgcaacctctgcctcccaggttcaagcgattctcctgcctcagcctcctgagtagctgggactacaggcgcccaccaccatgcccggctaatttttgtatttttagtagggatggggtttcaccatgttggccaggctggtctcaaactcgtgacctcagatgatccacctaccttggcctcccaaagtgctgggattacaggcataagccaccacacctgacctcttccagacttttttttgagcctgaatatgcatgcagtacacacatcactcttcactaaataatgaagtcatatcaaatgttgcctgtttttaaaaactttctatgagacccctttttctatcaggtagcctcatgatttccctcgattctcctgcctcagcctcctgagtagctgggactataggcgcccgccaccacacctggctaatttttgtatttttagtagggatgggatttcaccatgttggccaggctggtctcgaactcctgacctcagttgatccacccgccttggcctcccaaagtgctgggattacaggcatgagccaccgcacccagcctcttccagacttttttttgagcctgaatatgcatgcagtacacacatcactcttcattaaatgatgaagttatatcaaatgttgcctgtttttaaaaacttaatgtactatgggaccccttcttctgtcagatagcctcatgatatccctagggtctctgtccgttgtagagatgcagcaccatttgttgaaacaatctcccaaggataactatttaagttgctcccccatttttaacattacaaacaacattcttgtaaatccatcgttgtttcttccctgattatttccttaggctgaatttttaaaagaggaatttctaggttaaaggtcgacttaattctggctagttttgtttttaatgaaaataattcaagtatacggtaaaaaaaaaaaaaaaaaaaaaaaaaaatcccaacagaacaaaagtaagactttctgaatcctatacacttaactttacttcctggtggaaatcaccataaaagttatatgcactcttgcagatatgtggaattggttttttattgttgtaaaatatatttaacatcataaattttactgcctttgccattttatgctttgctttgttttttgagacagagtctcactctgtcacccaggctggagtgcagtggtgtgatcacagctcactgcagtcttgacctcctgggctcaagtgatcctcctgcctcagcctcccaagtagctgggagtgcagacatgagccaccatgcctagctgactttttttattccttttgtagagacagggtcttactatgttgcccccagacaggttttgaactcctagcctcaaagaattctctcacctcagccttccaaagtgctgggattacaggcatgagccactgtgcctagccaccttaaccatttttaagtgtgtagttcagtgatattaagtacattcatatatttgtgcaaccgtcatcactatccatctccagaactttttcatcttgcaaaaatgaaactccatacccattaaacaataacctcccatgcctcctacccctgaccccggcagctactgttctactttctgtctctatgaatttgactaggtacttcacatatgtggattcgtggggatatttattgtcctcttatgactgacttatttcacttaccatgatgtcttcaaagttccttcatgttgtggcacatatcagaatttctttcgtttttaaggctgagtattatttcattctatggatataatgcattttgtttatctattcatctgttgatggacatttgggttttttctatcttttggctgttgtgaataatgctacaatgtacattggcataccaatacttgtttgagtccttgctttcaattttttagatatatctccagaagtagaattgctggatcatagggcaactccgatttaaatttttgggggaactgccctactgttttctacagtggctgcattgtttcactcggtggaagtctcagcaatgcatgagagttccaatttctccatgtcctcacttgttattttctgtttgcttttttttcttcttgtagccatcctaatgggtgtgaagtggtatctcattgcaattagagttggtgttcatgttgcctgtcactgagggggaaggaaattattattattctcatcttgaaatgatgagttgggaaatagtcttagaatcaccattaactagctgatcagtcatgtaatctgaagagactacaaatcgcttaaaggaagaacacagccccactgttcccatagccccaaagaaaaaaatgagtggagtgcccaggtagttacttggtttcagaggtttaatggtgaccaggactggcttttcatgttgccccatccgcttacctgaatctatagtcaaaggtttgttggagagtagatttaaaacagttctctcgaaaaaagatgaatttatcttttgtgcaactgttattaataattctaagcgatggtatcttattcatcttacgtagtggataaagctagttttgtgattgattttttttttcctcttcaccttctactctggaattccttaggggtagaaaatgaaagtccttttttttttttttacaaattatttgctgaatcgtttatttaatgattcagttggtagcctttagtggagtgtactaaagtctaagtatttaattgtgaccctcttttgttctttacttgtattaataattgttttcataatatttatatcctgaagtatgcagatgcatttggttcctgaaatccagttttaaaaatttggccattaaaactatcatgtctttgtacgtagctgtctttttctctctgatattctcactagttgtaaaatgatattctagccaactggctttcagtgggatggaatgagtttaatgctatgtaaaaactggcaactttaaaagaagctatccagcttactttgactgcatggtggtgtgtcttttcttacacttaaagcatttagatcacagagatcagtcagtcagcagcctgttttgtacttctctgtggcattggaggccatttaaaagctacaggatgacagccttattcccagctcaggctcttaatgttggaggctagatcccaaataaatgtatagccataaatgctctagaaacaaatggaaacatcacaataagctatacttacacctctaatagatatttttctctctctctaaacccgggctataaaatgagcaattcacaaaataaaagtgtgctggaattgcctctaaaagacacttctttatcaaaaggccatcctcaagccattttacgaatgccctgtgactcagaagtgtcacctcaattaaagttatccttgaactcttaggaatcaaataggcatggtttggcaaagtgaaggcagaaagttgaggtctgtatcactcagaagttgtatttctgttttgtcatttaaaatgaggaaggtagaaatgctaaagatggatttactgcctcattttctttttcttcttttacttgctaagaattttcacccaccagtgactttaatatgttttgctccatttgttttggtaacgtctgctcagtctgttctttttattttgaattcttagttgggttctcattgtctctctctattagaagcagcttttctggaacttcttgggtaacttttctagattattcacaaagtcgataacaagaggagtagtgatgtaaaaagtgtcaatatttttagatcctagagtcgtgcaaaactgtcctcttgatgcagtgcttagcattgtctagttactacattggaagaacaagatgccttgtatattttacgtgtctaatcatatattcatcttgcctcaaacccctttactccctttacattcaggcattgttagaagctgagaaagtagacatacaatactgttgttttttcaattcagaagaggctaaaacattatgaagctggtaactctatgcccacacatggaagtaatctgcctgagcaatacctgtcacaatatcaacatgcagtagaggtgagcagaatgtaattcatggacaaccttgctgtactttccagtgaagggttataggatctgtgacattttggtattattttcgtacgcagtgcccaaaatttcaaacaactctaggtttctatgacctttagtcataggtcatctggcaggagaagagaaaagtggtctggataagagatgaaaaggggtcttgagaaaattaatgagaggctgaaagagatacagctgggtcagggagtgatcactaagtttccaagtaataaaattcattctatggggccatagagcagcagtgtgtttgtgtgtagcccaaccctgacttttccatatcagttgaagactggcagttgatcatcttggcatgaaattgagtggctagaaagaagtaagggtatcctagggcatgatgatataaggcagtgaagatggttaagaaattagaaatcaggagtggtagagaaacagtggtcgttgcagtagagagagacaagtaaacggagtccatgaggagatatattatgtaggatttgacagttgactgttctgtggtctctctggtgactgagaaagaggcgtcccattgattgattgattgagagagggtcttgctttgttgcccaggttagagggcactgacatgatcatggctcattgcagcctcctcgacctcccaggcttaagccatcttctgcctcagcctcctgtatagctgggactacaggtgtgtgtgcaccaccatgcccagctaatttttaaattttttgtggagatgagtttttgccacattgttcaagctggtcttgaactcctggcgtcaggtggtcctcttgccttggcttcccaaaatgctaggattacaggcgtgagccactgtgcccagcagggagccccatttaacttgaagcatagtgatcagattgcaaataatggagaagtagccaataatgagagtcgataaactcttcgttgtcctatggggggagtatgtggaaatcttttactgaaagtccctataaatttgggtagataaccaaccgaaacctatatgtctgaaatagataaaatgtaatatctcaggagtagggaatgtgttgtcagttccaacagtaccattcctggtctttatcttcctttgtcaccatgttccgtgaatctctattgtgttttctctgtgcggagcctatagcaggtctttgtggaaggcacaaagaaggactgctgctctccggaacttataagtggagaacattgaaatgaacattctccattgtaatagaaaaggacaaggaatttctcaagaccagaaaaatgtatcaattgggatattttactgtgcacattgtctcccctactcttcctgaaaaaacaaaatatccctcttaaaaaataacaaccacgaaaagcaccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattaaaaaaaaaaaaaaaaagtcagtcctggtttttgaagtcagcaaaatcaaagtatgttcatgttaagtggagatgcttgtcaaatagctgagaaatgaaagtatctgtgaaatctgtataattttaaaattatgatatactgaagtaaatagttctaagagtaatagagaaaaaaagtggaacctcaaaagttggggagcctggtttttatcacacttgttttttctcccatttgagaaactgtaattactttgatttgtgtttcaaaagaatttttactcatgaagaactagagaactgctagaaaactgaacaattaagctatggatcctctgcaaatagatcacagcctttaaatcaatacttcttcaaatactgggagataaggaatctataagcattatccttgagcatatatgaaaaacgttacaaagtgaagttaactctttttttcagtcccttacagatgtatgaataaggaatccatgggtttaattagaagagcaggaaatatgtttttgaggttgaaaacctttgatacaatgtctcaatactttatttggaacagcatgaattggaaattacgtcatctactagtcactgaagatattaactgtgaaaaactataagtagtaaagggtgatgataaatggcagggaatattctatatgggtggtgtctttcgaattaccgtcatgactcattttacatctgatgttcttaacatccttactaataacttggagaaggaaatataatgacacacaagcgaaagttgcatatgatttctagttgggagatgttgcaaaccaaatcagaccttatggaaagacatcaataacgtggaggggtagaacatcatttttcgctacctcagtgtatgctattttcttagaactttattttttctggccaggcgcagtggctcacacctgtaatcccagcactttgggaggccaaggcaggtcgatcacctgaggtcaggagctcaagaccagcctggccaacatggtgaaaccctgtctctactaaaaatacaaaaattagctgggcgtggtggcgcatgcctgtaatcccagctactcaggaggctgaggcaggagaattgtttgaacccgggaggcggaggttgcagtgagccgagattgcgccactgcactccagcctgggcaacagagcgaaactccatctcaaaaaaaaaaaaaaaaacaacctttattttttctgattttaaaagtaataactagtttgtagaaacattaaaagtaaaaaaaaaaaaaaaaagtaaaaagctaaaaagaactgataatttaatcaccctggggcaatcactgttaactttttaaaatatttactttcagtccttttgccatacatttttaactggttgagatcataccacacacataattttttccacacacataactttgtatcttttccacttcgcattatatagaatttcccatgtcattacaaactttttgtaaacatctctttgaaaggctgtgtgtaatgctcagttttaaggctctagatacatagaggaccagatctgggagaactggaatttggtggttgtgtagattcccatcaatattatgtttaaatctaccatgttatagctgagaacgcaacattttctttacaatataaacataaaaataccgtgggaaagcagtttgggcttgtgggctgcattctgcaaaggcttgttgaattaatgtactccctataggatctgaacaggattccagttctcccttccttactaatcttgaaagaagcctttaagagaagcctttggcaggaggcctggccaattccaggtaaaggactatgaattcaacttttcatgtctaagattctggcagctatttccactagtggctttagaaatctgtactacatgagttgatggtctcatctggcccctgtttcttaactgcatcgggaggagtatctggcctggcaatttaggatttcttcatcccttattgaatggatgccaagctttgtaaaagatggcttggggtaattttctatggtggtgtgtttgctcctgagtatcaaaagtttcaataaaaggctttctgttctctgacaacagcccatttttcccagacacatgccttgttgtttttccatcattgacagtagataagtttggatgcagccaaaagcggttggcatggacccgcacttgaggggctcctgggatggtcttccagccactcactgtaggcaccaccttaactgatgccttcttgacctgaaagctctttgttccattagctttttcctcctcagcaatgacttctgtggtgatggctgttgctttccttctctttccatttttcagttatcgctttcctcccagcatgtctgtgctgtgtaattctcttgtaaaagttgcttcttgctcataagtccccaagcggaggaatggagcagttaacctgctgtttcaaaaagttgtaatcgaaaccatcattctctgtaactagaattcataaagaagcattatgaagatggagtttttaattcagtaaaattcaataacagtaataatagctaagcacgttacctacctagaaaacctatgagatgtatattgttatgtccatttcagaagtgaaaactgaggcacagagaggttaagtagcttccacaagattgcataactgtaagtcttcttaatactaattcagtcttaccactaggtgctgaaagtggcacgggtttattcattccattcttaggtccctagtgcctagataactcattgcactcaggccttgctccataaatctaaatattttgtgatagatgttgagtttcctgttgactgaagtaaattaagaatatttagcatctcctgtgcaaggcacatgggtagatacaaagattaccagaacccagtcctcctcctccagcatttatagtccagttgattcaacaggcacatagagaagcagccgtaaatataagacagaggacagtgaatgctgttttagagattcaaagtgagttcagtaggaacatgggggaggtgagagagaattccaacagttgacatctaggatattttcgtgaaaggcatacaatatgggtttacccctcattgttgaatatgtcttactaagtggtaactggagtgtcctgagtttaatttaatctgttttgggatctccattcttgaagcacctttgaatcatctttctaaatgttttgctatacatctagaagacgtatcaaatgtggaccttggctgggtgcagcggctcatgcctgtaatcccagcactttgggaggccgaggtgggaaggtctcttgtttaagcccaggagttggtgaccagcctgggcaacatagtgagaccctgtctctagaaaaaaaaattaaaaattagctgggcatgtggccgggcacagtggctcatgcttgtaatcctagcactttgggagaccaaggcgggcggatcacctgaggtcaggagttcgagaccagcctgaccaacacggtgaaaccctgtctctactaaaaatacagaaattagccaggcgtggtggcgggcacctgtattcccagctactcaggaggctgtgacaggagaatcacctgaacccgagaggcagaggttgcagtgagctgagattgtgccattgcactccagcctgggcgatgagagtgaaactccgtctcaaaaaaaaaaaaaaaaaaaaaattagctgggcatgatggtgtgtatctgtagtctcagctacttgagaggctcgcttgagcccaggaggtcaaggctgcggtgagctatgatggcaccaccgcactccagcctgggtgacagagcaagatcctgtctcctaaaaaaaaaaagtgtaccttacctctggctgtatttaggaagctccttttttgaataagtatgtggcttgaactcattatttctaataaaaacaaaatataaaaatgatatcattggccgggtgtggtggctcacgcctgtaatcccagcgctttaggaggccgaggcaggtggatcacgaggtcaggagttcgagagcagcctgaccattatggtgaaaccccatctctactaaaaatacaaaaattagccgggcgtggtggtggatgcctgcagctactcgggaggctgaggtacgggaatcacttgaacccaggaggcagaggttgcagtgagctgagatcgcgccactgcactccatcccgggtgacaatgcaagacaccatctcaaaaaagaaagaaagaaagaaagatatcattgagcctttttaagtaacctgatgtaatgttctctgccttttttctataaaatagaggagcccagaaaatggggaaaaaaaggaataaatgttattctttgggaatctgtggagcagatgatgaaagtaaagaatgagtcctaagatactaaagtcagagctatttagtgttagcgagatttagaggtagtctttatggaagcagtaggttatctttcagagccgtagaaggagtgtttcagataagaccgaggtgaatgaacacagcaggcatccctgagatggaaagcttctggaaaaagatgggtttgttctctgactcacctcattagatactgactacacccctgattattttgtggtcgaatcttaagtatcaggatatcacagcctcatgagcaacttttttttccacccattctaatcgacattcctggccagagagaggcttacaggaaaagaagaatatgtggtaaaatatacataacataagcagcttagccgtttttaagtgtgtagttcagtggctttaaggacattcacactgctgtgcaaccatcaccaccatccatctccagaactttttttatcttgcaaaattgaaactctatacccattgagctacccgcccccacccccagcccctggcaaccaccagtctactttctgcctctaattttgactactctaggtaccttatataaaagtgaaatcatacagtatttgtcttttttgtaagtggcttatttttactttaatgtcttctaggttcatgttgcagcatgtgtcagaatttctattattattattattattattattattttagatggagtctcgctctgttgccaggctggagtgcagtggtgtgatgtcgactcactgcaacctccgcctcccgggttcaagcgattctcctgcctcagcctcccgcgtagatgggattacaggtgcatgccaccatgcccagctaaattttgtattttttgtagagacagggtttcaccatgttggccaggttggtcttgatctcttgacctcatgatccacccacctcggcctcccaaagtgctgggattacaggcgtgagccaccatgcccggccaatttccttcctttttaaggctgaataatattcgattgtatgccctaagtcttttttttttttttttcgaggcaggatcttgctctgtcacccaggctggagtgcagtggcacgatcggggctcactgcaacctcaacttcctggctcaagcgatcttcccgcctcagccctccaagtagctgggactacaggtgtgcaccaccacatccagctaaattttttggaattttttagtagagataaggtcttactgtgttgcccaggctggcctccaactcctgagcttaagcaatcctcctgcctcagcctcccaaagtgttgggattacaggcataataagccttttaagtagcagttttttggttgaaaacaaaacaacaaaacactgttgcaggcatttacctcttttctgattgaaactattttgtttcccttctctactctgaaagacagaaaagctctggaaatttctgctggggaaagaaatttcccatttttgtcttcagctcaagacatttttggagacatttgactaaactgtttactttaaatttgtcagattagaaagatgctttttcatatgtgtcaggagtttctcacatgtctatgttttttaaaatgttttagttttcaaatggtagattgattggtgttttaacaggaagctaactgttcaaaatgattacaggcccattatttttccactaaacgtttcgacactagcatcagagcactgagagacacctgcactgtgatgcttcccattagggtatattctccacgatgcctccttgagccaccatatctgtctctctgactctctaactctctaaatcggagtctgaacttagtattgttgtttgcacttgattgacacccagtaactatgtggcatgcatatatgtggacttaagggcataatagaattggaaatttttccatcatagtcaaaccaattcaccaaaactgatttatccctgtagtgactgtaaactatgaactgcctttagataggcagcctaagtatctctcaaaccttaatttcatctttaattttactgccttaggtggattattgtgtcaacctccccattgtcttcttggcttttgcatgtccttgcttttcttcttcattcctcccaataccaccagatcatctgtcttaaattcacaaatttgattgggccatgcctctacttatttttcatcactactggttgcttttaagacaaagcaaaagcaaaaactgtaacattggccctaacttaccttgctggccttttgagcccaagcagctctccagtcacctcccttcaactcccactgcgaatccctgccaccctcgatcctgtgctgggaagtccccattccctgcacacatacctgccttgcctcctgcttttcttcagctagaatacccttcccaccagtctctacttggcaaaattttacccatcctttagaatttaatgcaagttgcatcattgctgtgaggcatattttcccatgaacgtttgttaatagctctttgttttcttgttctataggtgcctttatcgtagtgcttatccctttgtattgtgatgctctgttaatgattttgtctctgctgctatattctctttttaattttagggtcgggggtacatgtgcaggtttgttacatgggtatattgcataatactggagtttgggcttctatcgaacccatcgcccaaatagtgaacatagtacccaatagatagtttttcaatccttgcccccctcccttcctccccacttttggagtcccaagtgtctattgtttccatttttatgtccatctgcacccactgtttagctccctctaataaataagaatatgtagtacttggttttctgtttccatgttaatttgcttaggatcatggcctccagctgcatccatgttgctgcaaaggacatgatttcattcttttttatggctgtgtagtatttcacgatctatatgcacctcctttctttatccaatccactgttgataagcacttgggttgattccatgactttgctattgtgaatagtgcttctgctgccaaattttgaaccctttaaagatctaggactctgcccatctcacctttgtagatacagcatctggcttagattgaggctcatggtagttctagaaaagaatgctgaatgaatgaatgaatgaatgaatgaatgaggaatgaatgaattaaggtaattgaatccaaccttcattttagaggtataaagaaaaactgaagaaaatatggctttgacctcaggtatctcttacacatagaaatgtcatgagcaagtgtgggatacatgtcagtctgtgtgtcccacacattcctgaaagctgctacttttagccaactggaccttagttgactcttaaaggtgagatgggattcaaatatattgggggaggaggtgccatctccaggtaaaggcctggattatgtcatgattgaatacgtaaaatattttggatctgaaaagatctttgtatgctagttgaattcatacagctacttcatgggaaaattaagatttagtccacatgtgtacagcatgtttcatgataaagcactggacaaataaaaccccaactggccccgtgatactcattccagccatatcatctttctctctcccttacccaccatcttaaactttcaaaatatatctaaaaggaaggcattgttaatcaaaagataaaaaactaatcctctagtaggaggaatgtttatgatttccttttatctgtcataacaacagaaaatagcattttaaacattttaaagcatgatggcaaattatgttttgccaatgtggtatatgaaatggaaatttactctggctcgttcatcctctgtgaataagatgatcctacaacaaaatagcatgcaggctcctctctcgggaacagtgggggtaaaatataaacagtgttttcatatactgtcagacgtttagagggctgccttccatgattttaatattgtctgactgtaccttctccacttcatttagcacatgagtaggttttgatcccatcttcgacactgcatttccccatcatgagaaggccctactaaatcttagaaagtcattttgcttcaacgaagagacagtctcacccctcctgttactgtcatatgcttctttccagttttttagaacatggtctctagaggtgttcaaaaagcaagcaaatgaagcaaatgatcagattttggcagaagttaaactacatgataaatgatagaatttggctcaaattctactggtatacacacagacacacatgtccctctgtgtgtgtatgtctaatatacaaatataaaacagacttcatctctatatgttcagtagaatgatagatactaaagtttttattggacagattgaaagagtaaaccctaaaagacaaataaatattgaagaatctaagatgggaccaggtgttttgtattcagagaaagtttcccattagtcttgagagttgaagagaaagatagctgttaggagacatggcaagttgcagcagcaatcagaagtaaaccctggagtttcttctgaactttgggaatttatatgaacagctgttaagaagctgtgtgtgtgtgtgtgtgtgtgtgtgtgtgtgtgtgtgtgtgtgtgtgtgtatttagacatatatatatgtgtatgtatatatatgtgtgtgtatatatatattcagacgtagtcttactctgtcacccaggctggagtgcagtggtgtgatcttggctcactgcaacctccgcctcccgggttgaagtgattctcctgcctcagcctcctgagtagctcggattacaggtgcacaacaccacgcccagctaatttttgtatttttagtagagacggggtttcaccatgttggtcaggccagtctcgacctcctgacctcatgatccgcctgcctcggcctcccaaagtgctgggattacaggcgtaagccaccgtgcctggccaagaagcattatatattctgagtgcattggtgtaggggtgtgtaagagatgatggcagaagatgattaaaaattgagtcttgtgggagatcaaatgaagaagatggaatctggggataggatctttgtctataaaattattgaaaaggctggtgtgatggctcatgcctgtaatcccggcactttgggaggccaaggcaggaggatcgcttgagcccaggaatttgagaccagcctgggcaacatagtgactttgtctctactgaaaaataaaattagccaggcagggtggtacacacctgtggtcccagccacttgggaggctgaggtgggaggatcgcttgagtccaagagtccaaggctactatagtgagcagtgattgtgccactgcactccagcctgaatcagagcaagaccctgtctcaaaaacaaacaaaaaaaaaccaacaacaacaaaaagaaaattattgaagtagtccccatgatggtaacaaggctctagactggcatcaaagaggaaggagataaatctgaaagcacagccttggtgatgggttggatatgagaaggtgcaataagaggtgaatttcaagtcatgagcctaggtgacaggataggcaagagaattttaggaagaggaggtgatgatgttcactcaactattccatagactactcattcttgtgatgtgttcatgggtgtcacaagaagtaggaattctgtagtcaggtaagtttggaatatactgagataaagttaaggataaagttaaacagtaactgaaggacttttcatagcctttaatatgctgtgatgaattgattagaccgagtattcagtctttgccaaatttatcagattatggggttaagtgttttggagattgtgtcagggagggagggtacactttggaaaatgatttcagaacaagagaatggggcgtgtgtgtgtgtacgcatacgtgggtgataatcacccatcaaagtgagagtcttttgatcataatagatatggaacttgagagaatgtgagagagcaggctaatatgaggagtatttggaagtcaggcagagagatgttcactggaaacatagctgagattagattcttctctatagcaaccaataattaataggaggataggtgatgtgtgttgggggttgaggtggggtggacaagaggaagcaaggcaagggcaaccgaggccccggaagacatcccagacaaatgtgctgtcaccagtaaccaggttggaaagagctggtacatggcagtgattgaaacagtagggctctaatctaagaggcgtagaggctctctggtttgtcaaggaggacgtctcctctctttctgcctgttgtggtaggtgctaatgctagggcaaagggtgagtgaatggtatcccactactccctgctccactcaacagacacttcaccgacctctcattttgtaaggataagagaataatgagcatttaggtcctactctcgaggtgggcactatttctgaaggaaaagggcaagaaaggtagttaaactgctaactgtgacatatttgatggattgattgattgactgactgactgactgactgactgtagagatgaggtcttgctatgttgcccacgctggtcttgaacttcctggctcaagtgatcctctcacctcagtttcccaaagtgttgggattacaggtgtgagccaatgcccccagcaagtgtgatatacttgacaactgcttctacagcagctgtgaatctgacaaggtctttaactgtgggcaaagaggtttaatatatttgaattctctaactttttgaggcaaccaaggaaataaacatcatatgaatagctctaagtcttaagcccaatttcgtaatcagaaaattactttttaaattttatttttccttataaccaagtttaaaaatagactgggaagcacacccctttggagaagttggaattggcctaacagtatgtgaggtgttacaaaggtaaaccctggtcctggaatggaattacaagtgtagttttttttcttttaccggaccatacgctttatttttagaattttgcgttgtattttactctggtgtatcttctattgatatcaaatagtttaagctgggcccaccaaatgtagatgagatgacagtttctaatgtaaatttctaagggagcagaaaagcttccggggaagcacacaaggcaccccattgtaaggacactcctttgtgctagttcttttctggctttgacttgagctggctcacagggcttctgctctgtgcctaccactcctcaccgagagccaagaagacttttcataatgccatctgtcataggtgttcatgaaggggacatgtaaaaataaatataaaaagtttacagtgagttttaatagcagtttagggatctttctgaattatggtaaacaaaaactgaaaagttacagatatggtcatatatagataactgttttgaccctcctcctgtcactgtgtcctgtagctctctgtatcccatatatgagcaggattcaggataactgtgtggaatggttgggcacccctcagcacaccattctggagaaccaaccccacaactgcagtttcagtgtttgctttgatgttcaccatcctcctgccttttttccccactttcctgcctcacactgaatgggcacttgataaatctgtactgaacagaaagggaaggaatcctctcagataccagtgttgtaaaaggaatgccatcaaagagtcatctttatcttgtgtcttagcagctgtttgaaaagtgatctcttgtgtttgactttgtgtgagtgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactgtgagtcaattaaacctctttcctttattaattacccagtctcaggcataactttactagcagcgtgagaaaggactaataaggtgagtgtttgagtactatctatggatagcttctcagaccaccatcttcttcttataatagctgccagaaagccaggcctctggacaggggagctttatcagctgctagaatgcaaggagctctctctctctctgctcccactacccattgaacctggctgcctttgtgatatgagagttgtatgtggtattcttggagaggagattttcagagattttcttctccttagcattgtcctataattggaagcttggagtttgcatgtgaattggaataaagtaggagaaggaattttatactcttgatttgagcaggatcttggtctcacgttctgcagtcacaaagaaacaaatacattagtcatttgggaactagattcccctggactccaatccagcgattgcctttcccgtaagcattagtttcttcattttggcagagaaaacaaattagttgctccactaactgaaatcatatggtggttatctgtcttgatgctgtaccactggatcttgtagcgctaggagtacatatgatactcccactgtacacgaaaatcctgaaacgtttatttagtgcttttggcaagacagcaaattggagaggtagttacattattaaatgttcaaaggaatgaactttctgaattattgatttttaaaagtcaggttttaaatggagataggtatgtggcaagaaagacaaaagttgacagcagcctggtaattaccatgtgtagaagaagatccacagtgatacagatacagctctatccatccaaccacatgcacatcctttcccagaccaagcagatctgactaatgtgggtgtgtgtactgggaagtcttcagctgcctcacagaaggaagaggaaataatgggccaagttagggagaagaacctgagagtctgttctataaagtcatatggcaaaatgggtctgtttccagatcccccgggaggtgaatgggctgtgtcctgagcatgtcaacacagccccttagtgcatggctggtgtttgtcgtggataagccaccttccttaaggcactcaggggagcaagaacactgtggaggaagccaaaggggagatcctgtatcctcttccccagccactgcaagcctaacatccctctttgttgccttctagttggaggagagatgtatggatgcgattcctgattgttctgtccacttagccctgcagtgtagctgaccttcagttatccatgagatatctgtgtactggagctagacattgcgttcatgaggcatgccctttgaaatttgggattctattcattttaagcccaattagccaaagatgttttcagaggtagagggaagctggaaggctgacgggaaagcaataattcaccaccgtttttctttgctcctgtatgtagggaagggcgggggctagaggttctcaactagggatgtttggaaaggtgtgtggtgttcagggtacatgcaatgactgggggacactatagactttgagtgggtagtggcaagggttgctaaatgtcctttaatgtgtgagccagtcttctacctgaagaaacacctcacctaaaatgccagtaaagggtaacactgagaaggagaaacaggatttgggcctctatgaaggctcatacagtcatgagagtctgcctgcttagccttctgggcagtctgtccccagagaggctagatacagccttccagttttggttcaaagccacctttctttcttcctttctttccttccttccctccctccttccctccctccttccctccttccttccttccctccttccttccttcatctttctaactttcttccttccctcctccctcttgccctccttccctccttccttccttccttccctccttctcttttcttcttcccttcctttcttcttctccttccttccctccttctccttctttccttccctctttctctttctttctgtcctcctccttccttccacctacccatcccttcagtggccaactatcctcccccatgtttccctcagcaatgttgtcacattgtctgatctactgtactcaagttcctctctgaactgagtcatttagtagcaatgacaagttcttaggccagtgagaatagagaaggcagatgtgtttggtgggaaaggagagagagaagagagggagaagagttaaaaagatgtttcataatttatctaggtatgagaataggcccctgaagttttaatccaagaaaaggcatttgattaatactaatggactccctcccacatctaggtcagtggttctcaaatgtgagcatgcatcagaatcccacggagggtgtgttcctagagactgctgggaaccatccccagagtttctgattgagaaagcctggggtggggcctgggaatttgctttactaacaagttctcaggtgctgctggtgcagggaccacacttctctaggtctgggtcctagagacaagagaaacactaggccaattcccatctccggagcactggcaggaacaggctgagatggggagaaactttgccatattctagacttttaactatggcccatgaaggagaagggaagatttaaggccagcacttcccagaagatgaggataataccagcttcaccatcacccctgtcgctgggatccatgcagaggccagtgtgctgtgttttctgaaataggaaggaaacaaaccacagtgagccttacttttttgtgtccttctgtaccaaagtaagtgcattgaattggtggccttgcttgatgtctggtagcttggaagttttggtaagccaggatatcaaagatgatgggcaatactttcttctgttactaaagaaggggaagttgtaaaaatgtgcaacctgttgaaggtctctctaaacctgttggtttaatgcccaaaccgttacatgtgtccttttttttttttttcagggaagcaaacaaagtcaggagtagggacagtgtttactattgcctttcctgaattctttgttcagtgataccagaagcactggttgtttttgttttcctcttcctaatgtgttaacaatggtgatgctttattccagccccacaaagggaaaaacaaatatgttggcagggatgctgctagaagtgtgaacaggaatgtgaatgaaatgaacactttgagagctgctatttttactatcggtacctgatttttcaaaataattctaagaacagtttttcatcaaatttgacctgatgccagaataacatcaagcttttttcatccctgatgttcccctggaatcatcaaatgttattagtttgagtacttagcggcagtttagaggtggcatattattttggtttccattttttatccaatacagaaggccctgcggcactaaataaaaatgtcaccgtgtaagacgtaaaggctttctgtcacaaatgtttttaaaaattcatgaagggctgaggatttgatttatcttatcctctttctgtgatttattcatatttaatgttgggttcaacgtttgaagcatgaataactttttcaaattaaaaactgtggtgaatcagttttttttgaagaaaaattctaccatgccagtttttgaattatgcagttcattcctcttcatgtgttcaagggccagagatgtttgattttcccagtggctggaattctcactggcaaaacccttcattgttgcaggagaggttgatttccccagctacgtggtcgtgacagctgttgccctggtatcaatagacattttccctcaggcatcaatcatgatcacacacgtgtggtagcaaaggggaagagtgggaacagacctcgccttgggaaccaatggatctgtatatttctttctatttttgagctgctgagttgcctgtgtttttaggaacatctttaggcagagataagatccagtcttctctatggacagttcataaataatgttaatagaattagccgcaaatgaaggaaaggaaatgaactcaaaacaaactcataatctttctttttttgaactagtcagtggaagcatagggtctgaggcgctggattttttctaagcccttggaggcttaaaagactataaggaaaagagctgcttggtggactcatttttgcctttgtggcaggcaggtagatctgtttagaggacatgagagtatctcccctttctctgggaggcaggtggaattctagatggctagacagagatgcaatagggtacactgtcctggacatcctgacttctgcctgcccatccacctgcctgcccgtcctgccctcctgggcctccattcctgtatcccttccttttgatttcttccctcctacttccatttttccagcctgcagtgacttttgagcatctccgttgggccagctattgtacctccatagactgagtcagcttctcataaactgaggggaactatgcctgttttctttgctaaaaatagtcaaccttttataagagtataaaggaagaaagagaataaacgctactaagtgcctacaaggataaagccctttttacctatttttctcccttgtttgtcattgaggatgaaacctattaaaggggggcagccagtatacagagcagggcataaaccaaagaatgtggctttttaaaccaatttcgagcattttgtcattatgatctggatcttattcctttgcttaatggagacaatcatcttgataagtaaaatcatctgtttttcccctcagactattgggaagaagttacctgcaactacagcaactccagactcatcaaaaacagaaatggacagcaggacaaagagtgagtttccttagttatctgtttcacatttaaaagcatttaaggatttcccaataacagaaatgttttttagaaatccctatataaccttgatagcttttgcaaacgcatcagaaaaatgtacacaattgtatttcattcaattccccaccattagggtgggcacaggttagattcagaactcctgtttttgtttttttctttccccttattacagaacgtggttctctcctgctatatgtatctcactcgtatgaagagctagggtttatccatatataacaagcactttgcacagttaaggtggctgaaagattttagagagtggcaaattaagcgctttagggattcacgagccctcaggtcggagaggcctaaccacttgaacttgaccaattttacttacccttgacttcccactggtatcttcaacacatctctgcttgaatatctccagataccactgcatgtctgcaggcaggaggctcaagtctttttggaaggattaggctaatgaatgggaggggttaactgtgttttagaacagtgctagccaatagaaatatcatgtgtgagccacatatgtaattctaaattttctagtagccatgtttaaaaaaaaaggaaaaacaattggacttaattttaatgtatttttatttaactcaatatatccaaatattatcgccacatgttatctacgtaaaattattaaatgagatactttcattgctctcttcatgtgaagtcttcacaatcccatatgtatttcataggcatagtatacctcaatttggagtagctacatttcaagcactcaatagtcatgtgtgcctagtggcaaccatattggaaagtgtagttttattttttaaaatattttctttttaaaacaatgttgtgggtacatagtaagtgtatatatttatggggtacatgagatgttttgatacaggcatgcaatgtgaaataagcacatcatggagaatggggtatctatcccctcaagcatttatccattgagttacaaacaatccagttacactctttattttaaaatgtacaattaagttattattgaccatagtcactctcttgtgctatcaaatactaggtctcattcattcttactattttttgtacccattaaccatccctcctaccccccagcccccaactacccttcccagcctctggtaactgtctgcctactccctgtggacagtatagttttagagtaattctggggtccaagaggggcttcctgggcttgaaaatgaacacagttccaaatgctcagcttgcctaagcatgtgggagaatcctggctccagcccaagccttgttcagtcctaaaagcgtctattaactacatccacatacctggccctctaggaacagcatggtgggggatgggttactcaaaagagtgggtttataggaagcccatattctaggaccagctctgttattagctagccatgtgaacttgggcaagtcattttattcctttggccttcctcttcatcatctgcattgtctgtgaagtcagagggttatactagagataaaccccagggtttatcccagcatcttcatcctctcattcagttctaaaagctttacaattcagaggggaaggtttctgcattcaaaaattaaacagctgatggaagagccaaaaggaagatgtgaacaattcagtaggaatatgagaaaggtgtctttgggtatagatgttaatatgcctgtaaatggtagcaggtcaggaaagggaattattactgtcatcaaaggcttgagggatgtttattgacagacatttttcatagacaccaggataagaatttctacagttgggctgggcacagtggttcacagctgtcgtcctagcactttaggaggctgagtgaggcaagtggatcacttgagcccaggagtttgagaccagcttcttggaaggctgacatgggaggattaccccaggaggttgaagcagcagtgattgagccaaggtcataccattgcactccagcagggtggcagagtgagaccctgtctcaaaaaaaaaaaaaaataaaaaaaaaaaaaataaaaaattcttcagtttcagcccacacacactgtctccagttgtcaagagcaaattctggggtaattgttcttccatgatttccatttagtgccaccccagacccctaagaagccccctaaaaagcccctttcatttggaccatttccctgcttcgggattttgatacgacacctatgtttaggtaacaggccacagagtaactgaacaactacatattagaaatgaccctgagcttgggatctgagcaacctccttccctcttccttctggccagaagacaaactataacaaaaattgcccagcagtgcagaagagggcagctccttcctgcgtagatgtctgtctccttagcatgctaaaatactagctcacatcagggttaagagttgtgatgattttaaaaatgttgatatgagttggtattttctgagtgaaagtgaaactcagctgatcaggatttagttaaacaacattatcatccccaccctctcaaaaaaaaaagcttttatgatattgaaattcatcagaaactcatgctggggaacagattgacataattttcataacaagaggaaaactgtctaaatattcataatgaagtgccctgaggttcctccagctcaccacatctggagtttccctctttcttattataattgatacagatttgtggcctctgtgggatagaaaaatagcccaaagggctattgaatatttttctgaaaaatagttcagtcttacagattcagaagaccagctgaacaggtgggttggggggaaaaatccttgacagaatttgtacaagggcagatcaggcttctgcataaattatgactgcaggacaaaggctgttttccctgctgaacctcatctcacttcctaactggacactcataccgcctttgcaatccctttgttcattgacttgcttcttaggagttctcatctgtgatggcaacaaatggaaccttgttgctatcattagatcattggtccctctaggttgaggctgtatcttctacttgatatccccaccatgcagcctagaaaagtgccatggattcagtgggcacataaaaagtggtggttgagcaaatggagaagtataaatgatttatgatttatcaggctgtagattgcacagttttttaaaagccgttagcaccatgcacggtggctcatgcctgtaatcctagcacttcgtgggggccgaggcgggaggatctcttgagcccaggagcttgaggccagcctggacaacacagtgagaccctgtctctacaaaaaatagaaaaaattagttgtgcatggtggcacatgcctgtggtcccagctccttgggaggctgaggcaggaggatcacttgagcccaggaggtccaaggctgtggtgagccacgaccgtgccactgcactccagtctgggtgacagagtgagaccttatctcaaaaatatatataaaaattaaaaagctattagccattggtcccctttgccaagtgtacatatacctgtatatgtaagcccctcacaatgagaccttaaacacaatggtaagaaacatctttcgaaagtatgttccaaacacctactttaagagccctctgcatggaaaacagttccattcactgtaggaaaacagcacataatgtatctcttaaaaagtatgcttagatttagctctaaaacatttatgtataaagccctcatgcacgatgagatgcaatgctagaaacatctcccaaaaacatgtttgaaacacttgcttacgaaattttatgcttggaaaacagttccattcgctatatgaaaacagcacataatgcatctctacagaagcaagtagatttagcttttaaagttgtatatggaaaccacatataatgaaacttgaaatacaatggtaaggaacatccttcaaaagtatgttcagaacaccagcttacagagctctctgctaggggaaaaaacaaaacaaaacaaaaaatcaaaacaaaatacatttgttcctgtaagacacttgagcatgttctggagtctgagtggttagcagtggttgctggtgttccttggcttgccggtgttccttggggcttgccagaccctctcttcttaccagccactgctctcccaatcggcctaagactgttaccagtggagggtgtccaggttcttggcgtcttgaacaaataattggacaaaacgcacaaacaaagcaaggaaagagtaaagcaacaaaagcagagattattgaaaatgaaagtacactccacagggtcagagcggacagcagcataggggctcaacagccaaattacagaattttctggggtttaaataccctctagaggtttcccattggttacttggtacacaccctatgtaaataatatggtggcccacagtcagtctgattggttgtggaaagcaaccaatcagaggctgaagtgaagctacaaagttacacttctatgcaaacatctgattggttgcagaaagcaactaatcagagatactttcaattttccatctgccccgcagaaaaggagcgggatttgcaaagggagtagcctatggtccttttgttacttaggtgtggaaagttgggattttccttttgatttagttctaggaagtcagcgtgaatcggccttaggttctctgcctccagaccctattctgcctcaagaccaccagggacaaggctgtagtctgacgaattcaggtttattggctcgttgtgaccagggagactgcacaccgggggacgtgtggatgttacaccaagcaaaagcaaaattaaaaaaaaaaaaaaagtcgttgcagattttgagaaggggtggaatttagtgaaatgtaaatgaaattatgttttgataggctcaaggcaaagcagggctgcacggcaaggggtcagcatcaggtcttgactgtgaggtggactcaggtcctgtttctttggcagctaccaagtgaagatagatgtgtagtgctgtgtccagaaacccgttacatgaggcgctgcacttgggctggaaatgaagactgcttctctgggtcaagtggcttagcgccttcaggccagagtggactgtttcattcttcctgatataatttttttaaaaaccaagtttctggtagtttgtctctaaaatcacatactttgtcagggagtgagaaagtaggagcactccaagaagagggttgttaaggacactttgcaactactgcatatgcttgggagagaaacactgtttcctgatcactttgcaggtggccttatctgtgtctgttgccccagcctcaagaatggctgggcagattgctacttactcagtgcagctcatttttgctttctcaccacatgtttaaataggaaaaaaaaaaaaaaaaaaaagagtcaactctcttgtgttgggttttcctcagcttcataatatatacccaggaactctgatcctattttttcagactcagtggttttgctcacatatcctcccccaaactcactcattcttgggcctggggatttgggcacatccaatttgctgcagcatgtctcatattcacccctttagtgcctcccatgcctgtcatgtactgaagcccctcatgcttgatgtcccaggggtacccacctcttcctaagaagcacctttcatcacttgctccccaatacagacattgctgtctggattcagagtgggagccttcccaggagggtgcccagcctacccgtgtggcttaagatctgcatttcaaatacagtcctcttgagaaaaaggttaactccctttgtgttttcctggtaggttttctttctcccaaagactctccaaggagcttctcatctgagcttctcatctgaaagtaccatcgagaggagcagtgatccagcctctgctgcattgtagagacaagaagggctttgcttgtcagattttcatttcttctttttaaaatatacttctctttttagaggaggttaaatggtgtcataattcatacttgtgaaataatttgaaagtcaaattcccaacagcatccgagaccgaaggtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtagaattgtctccaggtattgccagtatttcctgggaagccctagtttcaaactgctggtatagactgtagtaagccccacgagggcattgtggcatccctgctgcctggcatgcagtggacgctcagttattatttactgaatagatgacaagcctagtatgtatttcactactcctcactagccccagatcctcagaatctgacccagaactggagttcctgtctaaatctagcatatggcacacccacccccagtgctaccaccatacttgtccaccctccaggtccccacaactgttttgctccttcctggaattaaacatttgctaatacccattactagaccagtggttctcacagcgtggtcccagaactagcagcagcaggagcatcacctaggaacttgttagaaatgcaaataccagccctacagaatcagaacccctgggggtggggcccagttgatctatttttacaagctctccacctgatgccaatgcccactcaagcctgagaaccactgacctagactaaggccttttttttttttttttttttgagacggagtctgctctttcgcccaggctggactgcagtggcgcgatcttggctcactgcaagctccgcctcctgggttcacaccattctcctgcctcagcctccctagtagctgggactacagacgcccgccaccgtgcccggctaattttttgtatttttagtggagacggggtttcaccgtgttagccaggatggtctcgatctcctgacctcatgatccgcctgcctcggcctcccaaagtgctgggattacaggtgtgagccaccgcacccggccttttgtttttttttgtttgtttgtttgtttttttttgttttgttttgttttggagatggaattttgctgtgtcgcctaggctggagtgcagtggtgcaatctcggctcattgcaacctctgcctccctggtttaagcaattctcctgccttagcctccagagtagctgggactataggcactcaccaccaagcctggctaatttttgtatttttagtagagatggggtttcactatgttgaccaagctggtctcgagctcctgacctcgtgatctgcctgcctcggcctcccaaagtgctgggattacagacgtgagccaccgcgcccggccagactaaggtttttaaagcttctctgatgatgagaatcaccagagtatgtgtttagtaaatggattcccggtcccacctcagatctgaagattcacatctgcagggaagaggtctgggaagataatagaatgaacaggtgccccacaaaattcttatcagggatgattgattgggaaacataccccaatcctactcctctggtcagtgtcctagaacattgtacaaagcccactgtcattttcttcctctctgacaagatcctgagtctcttgtttgggaagtgattgtcccgtttcagatactctgacactttaagccgaatgcatggctctcatcctatcttcactgttgtctggtcaacactgtatgtttgcaaacccttttctgctacttgagctcctcgagcagatagtgtcttatttaccttaatttctctttcctagaacatgatagaagtccacacccttatgtgccattctaaaatacaaaaagctctgaaaactaaaatgttttattactcattgggtgataaaacttgttctggactgacatatgcctactcatagtctttatttttcccacttggagtgaccagtcatccatttactgcagaattttaatggttgggtgcagccccagcccccagctgaggatgttacgtattatatggtatatgcagtatatttcctttctaaaatctgaataatcctgtccccagggcttctgagtgagggattaccaaccagtagtgtctgagataatatttgtcagttgaacgagagaatttctgattatgatgtgcgtgaaactagattatccctgagcttgatacttttgttgtactgtcccaagggaaaggaaaactccagttttaggtgtgacctggtactttccaaatgctgcttaaagctctgaaagtcttcctagcagaatctgcctatgacacatggggttttgatctttataccctaaaactgaactcagagagttgtcctggatttaatgttatttccttctgtgtatatgttcagcttgctgatatatttattctgttggttctgcttttatttttttttaagctgagagggtttttgcttgtttgtttgaagttggtttgtttttattgaatagattataaaactagctgcaggcagtcatgtgatgtgggcatgtgagttcaattcctttaacagtctgtttttaatattatgtaaatttctaaaagtttagagattgaaataatgttttttggggagggtgtaaatcatgactggacattttggtgattttaatagagcaagcttcttaaaatttgaaagccaataattagtactggggctcttgatgtgggaactaggtaactaacagctttggggtcctcaaaccttctgatattgtatacattttctctgcacatttgagtgtgtgtgtgtatggtttgttgtgttgtgtttttttttttctggaaagagtcattgctttttatcagattcttaaaggactctaagacaaaaaaaggcttatgaactgatttaggatttcagtcttatgctaattcattagtcatttttaacctttctaaagaaaaaagacaaaatcatctcaaattgctggataaattatgctttattttttctctctctctctctctctatgtgtgtgtgtctattcattcctatttgatctctaattaaatccatccaattgatgaatagatggaaaatgcctgcctctcaaaattaatttaattcccttcttctccaactctgtccgatactcatttaaaatttataatcttcccacatccaaaggatgtggaattatacccttcttttaagacatatcaaatgcctcctcttttgagaactttctcctgaatgtaatcttgcctttctctgaaacacaacaatattccatcatagtgagtttatgtgtatgcatggctttgtcttttctttctgccattctcctccccttgcttttctccaagaattagactgtcacttccatgcagggacaggagggggtggttgggcttacttgtatattacagtcccccaaattggcaatgtctttttcatggtggtggtccaataaatatttaagtggaagtcaggaacatctttgttccatatactttaacattaaaaccacaaactcagagttaataatttttttgcagataacaattttgagtgtcttaaagccactgatacatccaatgcaacgtagtattttttttctttcttctaaaaaaaaaaaaacgggatacacgtgcagaatgtgcaggtttgttacacaggtatatgtgtgccatggtggtttgctgcacctgttgacccatcctctaagttccctcccctcatcccccaccccccaacaggccctggtatgtgttgttcccctctctgtgtccatgtattctcaatgttcaactcccacttatgagtgagaacatgcggtgcttggttttctgtccctgtgtcagtctgctgaggatgatggcttccagcttcatccatgtccctgcaaaggacatgatctcattcctttttatggctgcatagtattccatggtgtatatgtaccacattttctttatccagaaatatttttattttctaatactactgaattcaggctcaaatgcctcatcaataaaaatacattcctgttttaaaatatgtcataataaattaaagtgtgtgaagctaatggttgccgggtttggtcaggagttctgggtgatagtgcctgtgactagagtcatgaaaagtcacagctcaaagtcagagctcccaggaactcaggtctagcccagtgtgccccttggagccctcagagcttcactgacatgtctttggggacctgggtgggagatgggacagccctactccccaaccagaacagctctttttcagttcctttatatttgagctctggaataccttgaaatttgctaagtgtcctgctgaagttaaccagactctcctctctcccctccttagctggtccctgattttacacctgaggacactgaggtcatccagagttgtagtgtgattgtctcaggtcatgtgcttgcgaaagcccagctgggaacccaacctagtcccaagtatcctgccttctggcccaccgtcctctcctcctcctccttgtggcccctccaagtgttcctccactttataggggtcacttggagatcatcaagaaacattgagtgggagctctgtgtccggttttggggggtgcaaagagggctgagatatgctgcagcaagccctggcaccaggatctcctctttttctctaacagtggtgctttccagataattctgtgtctaatgccttacacataaaacagcatagctgcacagtcgaagtgttctaaagctggattatggtgatggttacacaactgtataaatttattaaaactcatcaaattatcactgattttcttggcattcctcttgcagttgaaatatgatttcaagagcaccaaacactgtactgacgtccaacaaagataaaactgttaaaaggagaatggcaggggcaactgtcttcctcaagtctgcctgtctgtctctctgtgtctgtctgtctctctctctctgtctctccatgtctctctctctctgtgtctctctgtgtctctcggtctctccgtctctctctctttctttccctctgtcacacacacacacacacacacacacacacacacacacacacacacacacacacacacacacacaccagggaacaaaatctaacagcctctcccacccccagcagatttcctctcacatctcattggctgcaaatagagcacctgcccatccctaaaccagtcaccaacaaaagagagtgagattaacattatttgcctggacatattttgctttatccccagggctgtgagagggttccatgttcctgaatgtaatgcctgaacaaattaggattctgtgaactaggaagagggtggggaatgtctgctgggatgttaaccaacagtctctattacacttaattaactttttttgactgaagggaacagaaacatgacctgttctttctttgttggctgtgggtttctgtattctttgtaaaaattgtttcatgatttccatccaaataattattcttaaagccaggactctgtagtgcagttcttcagtgatactgtgtttgtgttgttgtaagttttgagattggcagtcatatttcactagcacagtcaataggaaaattggtgaggagctgtcattatccaatttaaacatgttttaactttttctgtctctgtagaacatttgaccaattcagatttggggaggtttgctattactaagtaaagagagatagaacgttggtaactatatgggtttaggaatatggtattgatggaatttagaactattgcccctcagcacaggttaaggggcaaaagccatcagaggcccagaatacccaagatggaagatttccaacactaggacagggaatgtaactaatattttcaagctattgtaacagaatatgaaaacatctgcacaaaagcaaagtgaataccgcctctcctcccttcactccttccccttccccttcctccctctcttctctgtcctatcccaaccctagaccatagtgtatctgtattatggatttcttaattgcttttattttatatgtcacaatctctggttgttgggatgttaaccaaaataaataaacacatttcagtaatataaattacactagggacagtataattgtcatcaagaggttacctctaagacatagctctaggttgtgatccgtctgcaggaacgggcctgatgcttgggaaatatctaaggccattcacagccattaggtttgttgactttgatgcagaataatcgatgcctgtcccagtagatactaattctcttgaatttttctgtccaccttctgtcctgaatcatcaaggcctagttttccaagtctccatttccgaaatacaaatgttttcactatcttcgtaacttgtgctttcagataaatagagatgatttaacagcacatggactttcaaaagcatgtaattcaggacatacttaaatcgatttttagtggccttagtatttttccctctttggtgagggctattgcatctctttgctgaggaacagccatctatgcatagggaggttcccacagaaaggccatgggacatatttgaacaagcttacccccacacatatgtgtgtaaagaatgttcagtcaatacttgttggctgtttatggttggcatgtgcttacatagaaatacattgacatttgtctcttaagacgtaccataatggggtaacttttcattgttttatgtatcctgggtagctttgtaacatgtataaataccttgtttctaatttagtaatgtgtgggaaaaggcagtgaggcaaaacttaaggtttttttgccctctgtagactatatatgtttatgcatgcacctgaagagtatataaaatggtatatgtctgttttcctgagtaaggaaacctttttacctttctgccagagaaaagcaaagcagtcaggggcatctcatgatgtcacatgatttgtaaggggaaaaaaagtggaagccaataaatatacatgagccaaaaatgagcactctcgggtcattttctgagggtcaccctttcttcatgcagcagtaatatgctacctgttaagtgtgcctttccctgaacttaatgtgatagagatcattttctcctgggccagctcattagataaagcattttaaaggttatgttttctgtttttcttataggcaaggattactgcaaagtaatatttccatatgaggcacagaatgatgatgaattgacaatcaaagaaggagatatagtcactctcatcaataaggtaaacaaaggttgtctcctaccttctaaatcgcgaactgctttggggtgttgactggacagtataagcttttgcttcagcgcttgaaagcttggttttctcagtcctgaacttgtgaggaagaatcttgtatctttccttttgatcaagctaagcccagcatccaagtgaatgcattcgttgagacgagaatagatttgtttgccttaggaccagctgcagatttgcatggtccttcagaaaagtctgttccagaaggaataacccaaaaggcagcctgctcggctggagatcctgccctccacagcagccaggctgcagagctctgtgtcctgaggtatccgaggaggagtttttttttaaaacgctggtcatgcctcacaggcagaaaacgcttaaagaatgtttgctgttcagatcaaagacaggtagagtgcctgagagaatttttcctgtctcgtttgggctaagaagattgaatgattttattattattagagccagagccctgtaaataaacagagagctataaaatctgtgtgaagtgatgcaattgaacaagggccttggctgtgtactttgtgtgctttcacacaatggtactcaccaagtaggtggttgaaagatatattatttaagcaatacccagaatatatgactttttctctgaagaacagcatttttgtgatggtcaaatatggtaagaagctgaatggtcttgaagatgtgtatggtggttttattcttgtattcaggggagtgacagggaacttagcacagttcccttagcacaagtgtgacttgggagatcatcgtggctgcctgcgctcgctctcgcagggctgggaagccttggcagggtggaggatgcagggaaggggaagagattgcaggtgcatagagtgggagtaggcccagggtcccgccgactgtggccattactgagagggtggagactgtggtgtcacctggccctacccctcccccagggcttgtccataaggtgatcagtaagatttgcctttgttatcaagaggttacctctaagacatggctttagagattgtgtgttttaagagccaaatccaaacatgtcagggaactaatgacccaagaagttaactagcttgccacaggtcaggagttttagggagaaagctggtcctctcatggactccatataacagtggtatggagtatataatgctttctggaacagcaaatcattccctgttttgcagatcacccaagaactcgtccatctttttacctgtaaagtattctcccctgaagttatttcagtatgtctctgtaggtgttgaacatggcaggaggaaatgaggggaagaatgcttcccttgttgttttctgcaaatgaggcagaagtgattcttttctgtctctttcagattgctttctgacacacagtgcatttcctatttttaatcagacctgtaaccaaacaagcggaataaggaagttgttaaatgggtgtgaagcacaatacgaatgctgtaataattagcacagataatttggttttagaaatactgggaaagggctagagtgcttttttcccccttgatgataaagcaaccagagaattaaataactgctattctttgcagtgggagggagcgggggactcactagcctgtttttgttttgtctttggaagagagggagcctctttttagttgaaaacctggtatgtcaataatatttaatgaggtctgagaaaagacacacatctgtttctattttgacatattatactccagtccttccatttgaatacatatcataatgagaacacattcatcttgatgattttgttcctaacctcccagcctgagatccagtctgataaaaattaatgtgatttttctaatgaccttagtcagaaagggagtatctatcggtcccatccacatggtacagataaatgaacaggtagatgtggcaagctgctttcaagagtgttgtgaaggttacatcccatttctctggtttcatagattaacgtatttgaaagcaatttagaaactgaagcagcgcactgctattaatattatatttgcaaaacatgacgttgtcatctctgctgtacacttggtctgttgacctgactttcacattgatccaactcctcaggcctagagttctcatatcaccattttgacacttggtcctcctagtcccaccctgctcccacccacaagcctttctctatccctgccacttcctgccctgcagagctaagcacaggcttgagttgttctgtatctgtccaggccaggtgagcaaggaccaggcttcctccatccttctttctctatcacccaccatagcacccggtctggaggagagccctggggtagtgaaggatggagggatgtttccccccactccagtgtcccctacccacttcatccctagcacctcagccccttctttttgtcattctctaacactgctgtgctcacttacccttctgcaccaatcaaaatctttagtaactttctttttctttattgtaaaatccagatagatgatcctagcactccttcacccgtcctgacctcagtctgtcttggtggccttggtccatgtggctgttctgcaggtaccccccgtatatccccctcctgcttatgtgtcctcactaacttgactcagaccatgttcctgatgcccgagatgccctctgcctacccacattgctattttttgtttgttttgctttattttgtttttgagacagggtctcactctgtcgcccaggctggagtgcaatcgtgtgatctcggctcactgcaacttccacctcccaggttcgtgcgattctcccacctcagcctcctgagtagctgggattacaggtgtgtgcctgtacagtaaatcatgcctggctaatttttgtatttctagtagagacggggttttaccatgttgctcaggctggtcttgaactcctgacctcaagtgatccacgcgcctcagcctcccaaagtgctgtgattacaggcgtgagccactgcagccggcctagccactgcacccggcttccagtttgctgggtttttttggatagctaatcacacagccagtcttaactcatgctgcttgggcccattttagagcttgctgcttaagaaaatcctttgtgctctatcattttgcttttattatttttttatacaacctgctgggaaatcaaatctcttgctatcctgtgcttgtgcagatttttacttttatttccataaaatgcctgccagccttaacctagcattccagtttgccggaagcggtgtgttcagatgacaagtgccatgtaggctaccagctcccagaaccagggtttgaatcccagctccactgttcctggctgtgtcttttcgggcatgttgcttaccccctctgagtctgagtttcctcagccataaagcaagggccataaagctgacctcacagggctgctgcgaggatttactctggcagggaggagtctgtcagtggcacccataattctaggaattgtcacccaaccctggctgctctttcttgggccctggaagtgggaatggaagggctgttgtgtctgagcccagtttgctgctgaggctggaatgccatgacgttaagtaggttaaaatggtgaaaaatccacctaaaatagttaagtgttcacagtggaggagattttagcaagaatttggaaagaaaacatgccataaatattttgcttgctgaaagtgggaagaatggagtcggagcctgtaaaaccctgctgacattatagaagattgttactcttcctctaagttaggaatcgcccagaagttcattgagatgattgtatactattgctattataaaatgaatggtttcaccatgatctgtttaatatgcattctgatacgcatatttattggatgtaggagttgaggtgaaagacctgaactgctgttctctaaattctgtgttcgccgtagaggttcctgatagaccccgaattcctctgacatttactttggtatcattgaaggtggtttccctttgccctgcttttctgtgctgtagcaggagtcacagagcaggctttgccctcatttttagccccagattgtcagttcatgtggctttctagaaaatgagtcagacacctttagtgggtgtgtataagccctctgcagttcctgaaataatgtgcaaagacccaaactatttctgtatgtccctggaagccaggaggaaatgtggcaacctgaatggtttgttttctagtttatttataaagaattcttgtgaatttaggaacatttccactcgtgcagaacacacctgtgtttagcttttatttccagtcactcaaaaataactcccgtgtctgtgttcctgccacccccatccctgccttcctgatttgtgctcagagtgtgtttgaaaaggttccgaagcttctgggtctcatcccaactggagaagcttcctggagaagggctgagggcagcttggcaggagctatgccagggctcagctgcaagggtgagatggccattggaaggtgtcccacgctgtggccgctgccgcttggggcagaatgagcccagctgtggagagtggccatgttcccactcttggccaacagcctcctggcctcagagcaacagccattcctcacagctcccactaacctaggaggaaaggcttcctctgtgaccctattgtaaacaaggacctttaggtgtttcttatcaaacaggcttccttgggtagttgtgtctttgacccttaagcatacccaacctccctgtcttcattgttttaagcctatttgatgacatcaagatgaacgcttagaaagctaacgttattggtcaaaatcgtggagtcgtagagatggagggaagggaacggaagcaatattagctagcattaatgttcatggaaggaaactgatagacacaccctagagaaagaggggacccaggccgggctcagtggctcccgtctctaatcctagcagtttgagtggctgagacgggaggatcacttgagcctgggagtttgagaccagcctgaacaacatggtgaaaccccatcttcaccaaaaaatacaaaaattagccaggtgtggtgttgtgttcctatagttccagctacttgggaggctgaggcgggagggttgcctgagcccaggaggttgaggctgcagtgagccataattgtgccactgcactcaggcctaggggacagagtgagaccctgtcccccaaaccacaaaaaagaggggacccagaatattagctaaagacggttagtggcatccccaacacagtagtacagtcatctttccttggaccatgaggattatccactgaagattattgacaacaattttaatttgcaccctgtcctcttcccctcacaatgttcgttcactcattcattcattcattcattcattcattcatacatcgaagaatatttatggtgtgccaggagctgtgcaaaatgctggaatacaatggtaagccaaaaattcaaaccaggaattttgcttctttgtagggaccccaagtatttggagctagacatgctgtgagggcacagttagaaccgctccttttcatctctacctcaatatgttttcctccctcctgtcccagacaacagttgaacatttaattaacttaatgatagctagatctttctccaggaccacagcttcccagcacaggattctgaaccactggcagcaagagcccgggaccatcatcaccattcccctttcctcaggagtctccccggagctcagcatttcccctcatcttcacagcaaccccgggaattaggtgggaccatgcgtgttctctgcagattacaaaggaggagcagaggcccagagtgctgaagcagctttcccgagggactcccagcaagtcagtggcagagccaggtcagaggcatctgctgaccctgggccaagtgctcttggaacttgggggctgggcaaggtggtaactgcgggtggagttcgtgtttcctgtggggctgagtcacttccagaggtgactcttgtctactcattgagagtcctcattgttactggatatccagggcaagtgtctgtggagtttcctttgtaaggtaatgacattatcattgttacttagcagaaaaacagtattaccatgccatcaccccatcctttgttgctgatgctcgcgttttgaaatctatgtttccgatctgttagggtcaggacatcactgtggtggtttctggatcatccatgactgtaggagtccactgccacctctaaaagagtgaaatgatggtccatgcagagggaatgatgagttcagctcagggttgacattggttctttttgtgcctgaggcctgcctccccaactgctttcttccagtttcttcccatgcccagagtattttgccttcctcttttcttcctagcctggttgccacttagctttccactcgctgtcggggggcaaaaaaaaatgcaggcgggagtcctgaggcccttcctaagacattctgtgatcaactctgttattttttttgttctaatgtttatttccccttcctgcctccctcccattaattcattaatgaactaaaacatgtattcatgagaaaaatgttttcagacttccttgcttcccaccccacaggaaaataaggttgccttcacaaagagaagcagcctcaggaatctcaagcaagatccttagcttggcaggaagaaagccgatcagctaaatcgattgctggccctgaccctttctctctgaactgctgaagcttttagcagagctcaaatggtaggattaaatgtggttccaagggtgaggagtaaattagcacgtgtcaccctgaagatgatgacatgctgacagacccattagacagacatgttttatgagtgaatgaagaagttaagcataggtctgggatcatctgggtttacagacatttggaaaatgtcagtgttgagcaaatgagtcattgatgtcatagaatgtatttcttgcagcatggcctatcttgttagactgcttatgtccttattctagacaaaagtcacaatatatctcctcctcagagcatttaaaacccaaaggagtataatttgttgctgttttgtcttccttttataagtagccaggacactgggaccagtgagaagaatcattaccatcacacagacatagttttaaattacatgaggatggtaaacatagggcttggggtgggagaaaatatcgttttagttcaccagtagacagttgttgaaaggccaccccaacattttgatggtcgttattatagatttttcctttgtatcatggacagatgagcttgcagctgatgtaaattcccaggtgcatatgcctacacaaattatataaaactgtctaaagagatcctgtgtttgttcaacctaattgtcatatctctgcagaatgttgtgctaaagtggcaggacatcagtaatcccccatcttggaatacttttttttcccctctgcaacacacagaaaaaaaaaatctgtaggtatcttaaggaattagagaaactccccttttttttctgtttctatctccaccctttctatttgtattactctgttaggggtgttctgaggcttaaatgacatgttgtattcaaaagtgctttggaaacataaaggttaaatcacagggctgggtgtagtggctcacacctgtaatcccaacactttggggaggctgaggtagaaggattgcttgagccaaggagtttgagaccagcttgggcaacatagcgagagactctgtctttacacacacaatattttctttaaaggttaaatcatagttattgctatgataagttattagaagaagatgaaaagacaaatgcctggtaactgaatgttctttcctggtatattgaactgtcctgaaattaaggtcagtacttcccctgaagttccttttcattatttattttagcttttcttaggatgaaagtaatgtattacagttgtgtaacctgtcttgttcagtatctcagagtgctttgcattcatatttgcattttattaaaatacacggtttctgagatgaaagtggcatgggatatacttttttgtttgtttgttttttgagatggagtctcgctctgtcacccaggctggagtgcaatggcgtgatcttggctcactgcaacctccgcctgccgggttcaagtgattctcccgcctcagcctccgagtagctgggattacaggcaactgccatcatgcctggctaatttttgtatttttgtagagacggggtttcaccatgttggccaggctggtcttgaactcctgacctcgggtgatccgcccgcctgggcctcccaaagtgctgggattacaggcatcagccaccacgcctggcggggatacacttttaagtcatactttaaaattgtataaataacacttactcttggaaaaaaaatgagaaaaacagacaaataaatacaaagaaaaatcaaaattaccggtgaccttaccaccttcacatacctcttaatattttcgcaattattctttcagactttttccatatgtgcacataattacagtttaaaataaaaataggatcatattacatacactattttataataaccctctttgtccaaaatacatcatgattatccttggcagcatgggtaaatgattccttagcatcctgaatcctaatgtatggagagagtaccaaaatcctctttttttttttttttttttttttttgagtcagagtgtcactcttttgcccaggcttgagtgcagtggcatgatctcggctcactgccacctctgcctcctgggttcaagcgattctcgtgcctcagcctactgatgagctgggactacaggcctgtgccaccacacccagctaatttttgtatttttagtagagatggggtttcgccatgttggccaggctggtcttgaactcctgacctcaagtgatccgcctgccttggcctcccaaagtgctgggattacaggcgtgagccactcggcctggccctcgacaatcctcttttatgcttagcttgtttccagtttttctttgtgttagaccatgttgcacatagtcgtcaccctgttcaacagtctttgtgtgcatttctgccacttccttctagctgtgataccttggcaggttactcatctctgtgtgcatcagttttcacatctgtgaaatgagagtaataatagtacctacatcctggtgttgtgaagattaaatgagatgaagtaggtaaagcatttagaaagcctgggtcctaatagctgctacataaatgttagcagttactatttcctgatgataaattgctcagtgtaatactgtattgatgcattttgagggcatattgaggatacatcctgaaagattgtgccaatttagtctcctcacaggagtgcatgcaaatatatttccctattcttgtcatccctggatattatcattctttttaatctctgctaatgtgatttgggctctgctaattctgcattttaaaaaatgattaccgagcttgaacattttatgcatcatttccaattgatttttataaaaataccttatattcatgacattaacctgtcatcttcatattacaaatattttttcttagtttatgactcatggagatctttaagaaaaaaagtcattaaaataagtgccttttaggcttaaaatttcctcattttatagttaactgtatagtgcagtaaaatgtgtccttttaaaaatagttttgattaaggtttttatattttatttctagctggaaatggtagccaactattaaatgcattctttttctgccttcctcagggctttcagtgtttttatttaaagcttctgtctttacagtattttttttatagtggcattgagagagtccctgaggttctgcatggatgcgtataaggatcctcatatcctagaacagggtttggcaaacttctgcagagggccagggagtaaatatttcaggctttgtgggtcatgcagtctgtgtcacaattactcaactctgccattttagagcaaaagcagccatagaggtaaatgaatgggtgtagcagagttccaatgaaactttatttatggatacttagatttgaatgtcatataattttcacatttcttgaaatattcttcttcttttgatttttaaaaaccattcaaaaatgtaaaaactattcttagtttgtggaccatagagaaataggtggcaggctagacctggcccatgggctgtagtttgctggcccttgaaatagaatatctggaaatagactcataaaaaaatccagccgattaattttcaacaaagatacaaagacagtttaagagaggataatcttttcaagaaatggtgttggcgaccgggcatggtggctcacgcctgtaatcccagcactttgggaagccaagacgggcggatcacgaggtcaggagatcgagaccatcctggctaacatggtgaaaccccgtctccactaaaaatacaaaaaaaaaaaaaaaaaaaaattagccaggtgtggtggcgggcacctgtagtcccagctactaggaaggctgaggcaggagaatggcgtgaacccagaaggcggagcttgcagtgagccaagatcgcgccactgcactccagcctgggcaacagagcaagattccgtctcaaaaaaaaaaaaaaaaaaagaaagaaaagaaatggtattggcacaattggacacccataggcagaaaaaaaaaaaaaaaaccaacctgaacctattatacaaatttaactcaaaatggaccatagatctacatgtaaaacataaaacatcaaaagttatgtatgaaacactggagaaaagagttgttagacatgataccaaaaacacaatccataaaagaaaaaacttgccaaattgaacttcagcaaaattaaaaacttttgctctgcaaagacactcttgagagaatgttattggctagtctatttttcctacaaggccatctaagccccagtgttcagtaagtaattgcctgctacgtaattgcgtggatttgaaggaccttggtttcattctgagtcttcctgggaatacctcttgtaattcatggatctttcacattggagcctttccttgccccgtgccctttctcccctgtggtggcagacagacagagccatactccagtggtctgttctggactcagctgagcagcccgagggcctggatttgactttggaattgtattttttactcgctgcacaggcctagaagctaaatcagctaagtatagattaaaagccaccaaacaagttttcaggctaagaaatatgttttcctagtagaagaatttcttaaaagaagtgtggatttgtctggtgaagaatggaagtggaagataggaatttactaatagtcgctgcagctggcttcaatgttcttgaccttcaaaatgatcatgtctatgcccttcacctcctgttccttcccagtccttatctgtggaatgaagaataccaccttctccttttttaaagctttctttgtatctcttagaattggtgcaggagctaagaaaatctcttaaaacataataataaaaaatgctttatgaacgctactgtctacctgtgaagcaaaatgattttctctcatagctaccatccttttaatggaagaaaagcatgtatttggatgcagagtcaatgcagttctctaaaccataaatgaaggtaaaaactcagctataggatgctcatcctggaggagtagactatatattcagcaatgtgctatggatgagctgaaggtgccattagaaacagcttttaagatttccgattaagcggtcatctcaatgtaaatgacctagcaaggtccctagcaactttcccacaaaatgagaagtttctgtgaaaatgttgttacataagtttacattcttgattatatctatttatatttttttaattgtatttatttattttttttgagacaaagtctcactctgtcgcccaggctggagtacagtggcaccatctcggctcactgcaacttctgcctcctgggttcaagtgattctcatgcctcagcttttcaaatagctgggattataggcatgcgccaccacacccggctaatttttgtatttttagtggagctggggtttatgttggccaggctagtctcaaactcctgagctcaagtgatctgcccaccttggcctcccaaggtgttgggatttcaggtgtgagccactgcacccaaccacatacttgattatatttaaatggacaggaaaaaaatgtaaaagtgctagcttaataatttggattttgtgtatgacttgttcacatgcccttatatatagttaacgtctcttggaatacttaaagccatcttacgaggacattgggaaggtcctgtctatataaggatctccttttcacatgattactgttttttggtttttgttttgtttcgttttgttttgttttgagacagagtctggctctgttgcccaggctggagtgcagtggcacgatcttggcttactgcaatctccgcctcctgggttcaagcaattctcctgcctcggcctcccgagtagctgggattacaggtgcccgctaccacatccagataatttttgtatttttagtagggatggggttttgccatgttggccaggctggtctcaaactcctgacctcaggtgatctgccctcctcggcctcccaaagtgctgggattacaggcgtgagtcaccgctcctgcccgattttttttttttttgttcgttttttaagacagggtctcactcttgtcacccaggctggagtgtggtggtgtgatcgcagctcactgcagccttgaccttctgggctcaggtgatcctcctacctcagcttcccaagtaggtgggactacaggcataccaccacatctggctaattttttgtagagatggggttttgccatgttgtccaggttggtctcaaactcctagactcaagtgatccgctcacctcagcctcccaaagtgctgggattacaggcgtgaaccactgcacccggccaattactgacccttgaagtggacttatgggagtagaaattctttcattccacaattagaaaaaaggctaaagcataaacattttttagaagactttagattgcatatgttgcaaaggaaattatgaaatcaataaataattctggtatttttttgtatacaaactatatagccatgttccacaactctaggaagtaccaaatatgaatggtcaccctggagttgggccagcatggcagcatctgttgggtgctgttctctgaagaggctccagatagaaactgtttttttttttttttttttttttttgagacagagtctcgcagtctgtcacccaggctggagtacagtggcaaaatctcggctcactgcaacctccacctcctgggttcaagcgattctcctacctcagccttctgagtagctgggattacatgtgtgtgccaccacgcccggctaatttttgtatttttagtagagacggggattcaccatgttggtcaggctggtcatgaactcctgaccttgtgatccacccaccttggcctcccaaagtgcttagattacagacgtgagccactgcgcctagccctagaaacatctttttctaagaggaaaacaggctgagcacacagaggcctttagggcttctgcccttggttgtcttctatgaaaatccccatgggccttcctgattcctgccttcgtgacactgaacacctgtggaagtcctgttctcttactagggactgagatttggtttaaggtttttttgtttttgtttttgttttttcccctcatttcttaatgacatctgaactcaaaggttacttctgtagcatttcctcacctatgtgctgtgagggtagggtggtgatttcttcagctctccagggtggatgggaagggccttagctggccggaatcacccctctgggctgatggccttcaacaacctttggcctccagcagtatgtcataaaaataactactattttatgtgtgcgccattatctgaaaaaagctaggtggcactaacttactgcatgtatttatccttctgtataaagatgttcaacaatggctctactttagggaatacttcaccttccttgttagagaaaggaacatatgactggcaaaggaaactccaggataattaaaaacccttgtatgtgtcttcatttcacacattctttctctaggacttcttttgggaattagaccttgaaatagctcagacttttaaagatagagctgaaagttctattatatctagaatgaaaaagtccagtctaaatgaagaaacaatctttttgagggaatatataacttggggttgcggctattatagagtaaagggtaattagacttgccttcctgtcatagacaactctaacattggccaaaacatacaaagtggctgtttttaggcattggacaatacatatcacaagaatgtgatcctggagacaagggaagcataaaagtgagttttacatcaaccctggctttttgcctagaggcactttctaaattgcagcacagggcagtggagcccaaacaaagagtagcagactcatttattggatagaggaaacaagctgtaattcaggactgctggggtggctcaaattttcagggcagggaactgcaaaagaatgagctacacaaggaaagagtgtcagaaatgtatagatctagatgatttggccaaatactaagccaggcatcagtagggcaagactctacgaggcctggcagaaaataagaacttggaggggctgtgagctgagtggatatcccagagatcaccagtaatgggagatgttagagttctagctaagcagagtagaaaaacacgaggtgctatcctcgtgttgagaacttctggcatccagttgagaacccagaaaagccagccacaggaacagcactaccctagacccattgtaacaaagcctaaaaacccaagccttgaccagtcaagctgacctgcaagtaacctgcctaccatagcagaactcaacactctttcagggaagacaacaaaatccagtctttgaacaacagcatgcacagttgctcagcaactgttgagataatataatcgcaaatgactagatctgtgaagaagcaggaaaatgtgaggtggcttgaagaagacataggggtgtttctgagtacagttttcaggcattgatacctgcttcagttaatattggcatccccaagaggaaatgtgtttactgtttttttgtgtgttatccacccagtttcttgttgctagttatatagtatgtaaaaagaaaaaagcaaaagttagtatagcaaagcctgtaaattgttgcctgctaagaagccaggattttttgtaagtagttccactctgggtcatgacttcgttgtattacaaaagagtgagtgactgccagtcaggcgtggtggctcacacctgtaatcccagcactttggagggccgaggcgggcagatcacttgagtttaggaatttgagactagcctgggtaacatggcaagaccctgactctacaaaaaattaaaaaattagccatgcatgatggagtatgcctgtagtcttggctgctcgagagactgagtggaaggattgcttgagcctgagaggtcaaggctgcagtgagccatgatgtatttatccttctgtataaagacgttcaacaatggctctactttggaatgccactgcactccagcctgggcaacagagtgaggccccgtctaaaaaaaaaaaaaaaaagtgaatgactgcctaagccttagttatcctgtgatgttggcatttggaatgtagtgttttcttgagtaagctcgtccctaggactgtctcctcaggcttctttctttacttttggcctgccaggcattgcttctgacactgaatagtagtcagtgtagtcctcgttttttcttcttaccttataaaccatgatatgtggctgagcctcctttagtaactgatttatggggatgtagaaaattctgagagaaatcccagccatgcagaataattgcatctcttggggaggtgttaacaagcagaggcagagatgagtgcttctgggccccggcttccatggaactttcgctcaatagcccccacccctaagctctatgcagaaggcgttcattagcaaatattaaatgcctgtttccatactgctggtggatgctgagggtgtgaggccctctgggggcatgctgaggctcacttaacagcctcacccaaattgtccaacactcattttctcctcaaatgatatcagggaaggtcatgaagaacagccatgctggataacttctgggaaattgggactggggagcctgggggcagctgaccaccagaagtgactgagcagaatacatttctttttcgtttgcatcaagtggtgtacccatttttatgttttcagtttttggtttgaaatgtctgtttctaagctgcatgttcccatttgaactcaaagaagacacttacaatgcctgagaaaatgtagccttcctttttggggtaattttaaagtttttgccacaattttgaataaataataaattcagaacagatcagcaggtaaagcctgatcatatagatgaagcttcctttgtgtaggaattctatacctgcttcccccttgttcagtttgacctcacttctgatgtttgaaagtggagagaagtggaacaacagtctggaggaagattgggtcattcatctattcagtcaacatttattcagaattgacatgttccgggcactacggcaggaattagatggagacagaggtgtgaagataagaatcctcattttcaaggagcttatcgttttcaggaaccttgtgactcaaagtatggtccacggagtagcggcattggcatcacctgggaacctcttagaagtgtagaatctcagacttgccccagacctactgaatttgaattggcattttcacaaaatccctaagtgagaagcatgcacattaaagcttgagaagcgttcctcttaaatcactgattctcagcctacacactggaaaaacctagggacattgtaaaagcactgatttcctgtgcccattccccacccccaaattgtgatttaatgggtatggagtctggcccagacatcggcattttcttttaaattcccaggtgattctaaatgtgcagacaggtgtgagagccactcatctagtacatggctttgtactcttgacaaaacagcccaagatgagattgtagctcattctgttaaccaatgtacaagctaggtggcaagtttgtcttttctacagatttgaagtgcctagactagaggtaggcacaccaggtctcacgtgccctctctgtgcccacaggttgtatgtcagggagtcgctctcagctgtgtggagcacttcggccaggttacacggggccatgctggcaagattgaacagactgaggcccgatactgaagtctgggcaaggcctccttcctcagacacaccccggggccttggcatccctccccttggaccccctccaagtgtgtgagctgctgccagggggtttcacctgaggcagcagggactaggagtggctccttggcactcgaggatggcgctgggtcgcatgacaaatgcacatgagtgtaattaagcagctctcctggtcacattgtccctcagggattcggaccaggccatataatcacgatgatgacaataacaacaaccagctcttgtgtcactctttatactttgcaaagattttcacatgtgtcaggaaaccgagatccagggagctttcgtcactagggaacagcttaagtgtcacatggcccatgcttgctctgttccacctctctctgagttccacttgaacatgtcaggcaaaataaggaatggctcccttgtgacaaagtgagttccctgttataagcagtatgctaggagggagtagataacctgagatgtagcagaacgcagaggctggactacacaacgcctaatgctcaattcattcattccttaaaaggaaaaacatcatttgcattttatagggaaaagtatatgttaccctaatatctccctggtgttgaggcatagagaaaccattttggccattttaaggacttgagtttgaaagagtaaaaatgatatgtcagaaatatgatttctttccatattcttgctaagggtttaggtctactttcccctgagttcatgccaatagagcttatgtctaaacagcagctttctggaagcgtcatctacatgctgctccttttctcatttctacctcccacctcattcagagttcatcccctcacctgcctacaatgctctttctcatttgtattagagtctaaaactccatgaaggtgactgtcgtctggagttatgcctggggtcctggtgtaatttattaatagcgccccagatttggaaacaaattgtagtacttgggccacgttacctctctcctcagtggtcagctactgcctcaccatcctgccttcactcaacttctaccgtcttccttggggacatccacttccgccctgatggcagtcgggcctcacaagcggttgatcacctgcccctcctttctgcccctgtcactcagtgggtgctgtcttgcctcacacctcatatcactgttcagtagatgttggaggggcagggtttgttccaagctctaattcctgtatattctcttccatgagcacagctttcctctctccctcttctcttcctttacgctcagcaagtctgcccttgaccattctcattgcctcagttcttgtccttgttctctgcttccaggctgcccagcttgtcttggtcccacttgtttgtaaatccattctagcacttctgccagtgtttctgtgccattctgattcactgtgtctgcctctcccactagactctgagcttgggagccccacaaggacatgatggttttcttttctcccctggattcatctcctgtcctgcacattttagaagtctagcccagccattggcatttttttttaaaattcccaggtgattctaagtgtgcagccaggtttgagagccattttaggttctcagtaaataaactgaggccaggcgctgtggctcacgcctgtaattccagcactttgggaggccgaggcaggcagatcacctgagttcaggagttcaagaccagcctggccaacatgatgaaacctcatctctactaaaaatacaaaaaaattaaccaggcgtggtggcaggtgcctgtaatcccagctacttggggaggctggcgcaggagaatcgcttgaacctgggagacagaggttgcagtgagccgagatcatgccattgcactccagcctgggcaacagagccagcctctgtctcaaataaacaaacaaataaatagaatttgctgctattttatactttcgaaagcacagccctcatacaagtctcttcatctctgccatcaaaagactagttcttttgtctggtttgttgaagaggacttattttcacttctcattttgctgttaaaattattcctatttcccttaaattagcttgtattgctgggggaaaaaaatgccttgcttctctgtaaatctctatcccactccaggcatcctgaccctgtgcccactttctgtcttatagcagactcttttctttggctatttttcttgttttttttttttttttttttttctacttctgctagtagcactaaatcacactggcagttttctcttttgactgtacttatctcatccatggaccttgtgtttattcttgtaccaatcagaacaattagacatattgtgttctcccttcatgcttcccttctcttctttgaattatgcaatgagtagcactgttagtgttttccttaagaagcagaatatagatgggccatccaagccagtcatcaccaaggggaaatatgagacatacaatgtcattatgtaccattttctcccgtaggggtgtatgggatctaaagttattctgggccgggctcggtggctcacacctataatcccagcactttgggaggccaaggtgggcgaatcacctgagtccaggaattcgagaccagcctggccaacatggtgaaaccctgtctctactaaaaatataaaaattagccgggtgtggcagtacatgcctgtaatcccagctacttgggaggctgaggcaggagaattgcttgaaccagggaggcggaggttgcagtgagccgagatcacgccactgcactccagcctgggcgacagagtgagactgcgtctcaaaacaaaagcaaaaacaaaaacaaacaaaaaaaccacaaaaaaaaccaaagttattctggatgggcttttgctcattaacattttctatattgtttttctcacatgtgaagcaaaaaaggttcttgggttattatttgcataagactaagatgaagcatggatttacactgtttagaaagtttgagcccaggtgtggtagctcgcacctgtaatcccagcactttgggaggccgaggcagatggatcccttgagcccaggagttcaagaccagcctgggcagcacggcgaaaccccatctctactaaaaatatgaaaaattagccaggcatggtggcatgtgcctgtagtccaagctactcaggaggctgatgtgggaggatctcttgaacccaagaagtcaaggctgcagtgagccgagatcatgccactgcactccagcctagacaatgagagtgtgactctgtctccctgcaaaaaaagatagtttttttttgaatgccttttgtgggcatagttctgtatcagatgacctgaaatgaatgtggaaggaagaccagtcctcagctaagcaaaccattcacacatgtaaagatttcagattattgcaaaaactgttaatggttctctcctcttttggtactagagcactcatttgatccctgttacccaaaggaccttgcgtaatattgtatgtctgtctttcccatacatctctaagctccctggggttagagatcatgttctctgcatctgcatgtttaaggtttggtgcttacagagcttaaatatattttgcatttaatagatgtttattgaattgaatatcattaattgcaaattaacactgtactgagcattagagaaaagataaggcattcatcatagtcagtttcttaaaggtgagtttcaagttgagttttgaagaaacctaattccaagagttagggtcaaagaaattctactcccagcttccttcataagtttttctgttatcattgataatgtttgtaacatcctagggtcagaagaacctcaggagccaccaaatcctgccaccactcctgttcataaatcccttctttgaagactgatgctagtattcagggggtgatgtgacatgggcaggaccagactatctacttggacttctcaatgtcatttttccagaaagataagcatcctttcatgttgaaagacttttggacccttgttttgttctgggtaaatctgaacttgatacttcaagggtctttggttttttttgttgttagttggggctagaatttatagtctgtgactaaggactgatttccaaaatctgcactctcttccctaaggaagaccctaaggggtcagcttatctttgtaacagataccactggggcagtggaaggtggtgatgaattacttgctacctgaggtgggccttatgctaacttatagagaattcccacgagtttaggcagatagaggccatcctgttctacagtaattcaagtattggactggaggagatcgcagaactctcagggctagaaagagtctgcattgattctacaaatacttattatatgaggcattgtgtacatggctgggggtataatggtgaaaagtcagatgtgctcctcaccttgctggaatgtatgatctaacaaggtacaaatgagccatacaagccatggctctcccagggccctacagcaaggccttaggccagctgcacatctggtacttgagcccttttctaatcccactggtgtcgtggagaccatgggttctccatgggccctgaacatgatctcctctctttctctgtcaccttcttgctttcccttatgtgttatcagcaggtttttttgtttgtttgttttttggaaagccttttctcattttgggcttcagctggaagttgttgatcacgagacttgggagtctgctataggacaaaaagcaggctcagggtcaggatgcctgaagtgggatggagattaactgattacagggattttattcaaggaattttatatttgacagtggtgtgtatattatatatatactgggcaggaagcgttgcccaagtgaggaggtttacagtaggctggatgagccctgggtcaggcggtagaagtggaattggactcggaggacaaatgtgagacatatgataaaactccagcaaatgggacttccaaccagttgaaaatgggaaaaactagaagtggttttgtggcatgagattatgtgcccaggagaaccacgaggccattaggctcatgagaaaggccaggctcttgccatttttgctcgttgtcctttctctagcacctggctcagtgtccagaacaaagtagatgcttgataaatgtttgatgaatgaatgaacaaaatagagattatccaaagggaagcaagttcactctggaagaatggagagccttattcattcatttaggatgccaacattgcatcctgtaaagtggaggaagggattttcatgatggcaactgtgcgccatcaacatctaaaggagaaggtgaaggagagcagtgcattaatgagcttgtgtaaagtatgatttttcttctggttggctgactgtcacaaaaccttttttcaatattgacaagctttgtgacaggctaatcacatttgtgcatgtgatattttctaagccatatttgcagttaatgaaatacttttatttcagtaaaattaaaatgaagaaaacacatattctcccatccttaaagaaaaaagaaaggctgggcgcagtggcccatgcctgtaatctcagcactttgggaggccaaggcgggcggatcacctgaggtcaggagtttgagaccagtccggccaacatggtgaaaccccgtctctactaaaaaatacaaaaattagccaggcattgtggcacgtgcctgtaatcccagctgctgggaggctgagatggaggaatcgcttcaacccaggaggcggaggttgcagtgagccgagattgcaccactgcactccagcctgggcgacagagtgagaccctgtctcaaaaaaaaaaaaaaaaaaaagaaagaaagaaaggtaaaagaagaccttattgattcagggcatctaaaagcagcactgggttttgagtaccagccgacattgttaagcggacttaagcttttgttttcccctctgacattggggtttgtgctgacttggtaaccattgcctcattaacacggacctccaggaaagggcctccattctcttgaagaggggggttacacccctctggaggctgcttgcccccatctctcactctctgttctcctgttttctaggactgcatcgacgtaggctggtgggaaggagagctgaacggcagacgaggcgtgttccccgataacttcgtgaagttacttccaccggactttgaaaaggaagggaatgtaagtctccttcactttgatttcagcggagttgtggctcccatgttgggacttgggatgggggaagtttggtgtaatgttgaagagcactggcatttgaacattcaacagacccagattctgagccctcggctgccatatactctgtaacaagtttcatcataggatgcatctgttagctggcaacagtgatctctactctgcggttgttgcatacataaacaagatagtgtgtgtaaagcactcggtgcagcactggcacatttcagcacccaaataaactgtgagaaccttgggtgctctttttggtaagtggactgccagcatcccacatagcatggtccttgggggtgggaaagtagccagtgttgtggaagtggttgaaaagcacattgtaaggctgaggatgcagggcgaggcctgttaatctttctacactatatgcttacatgtgtgagtacacccgcacatatccgtatattagtatatacacatctctcatccacggtttctcttttgttgtgggagcccatttgaccatgccactgtttaaatcagccactccatctgtgtttgcctcactccaggtgtattctttccctgctgacgatgtaataagaaatattgggaagttagaagcactttccagtataagggaggagcaatcccatatttaggttctttgcccaggcttttgcgtggcctctgcccacctttcccagcctcaacccacttcatgtccatggggactctgttactggacggtgctgagccagatcttgccatggcacgattccagtagggctgaggtgtgggaaggatagctacagtgctggtggcttcgttgccaaggatactaaagtagcatttaatggaatttgtgctgctttgatgaatggatgtaattgtttaagaagctagatggtgttggcgcctgccaagattacggcccatagaccattaggttggtttaaaggctaagttagccacactttgtaagctttttgattgcttgctttcttgtattgtttaggtgaaggatgttctgttccacacctgttgttctctcttggagtctgagtttgggttctagagaatctggattctggttcttaatgtttcctagattcttgatgcttaaagtgagatccatggaccggcaatagcagcatcacctgagagcttgttagaaatgctcagaccccaccccagacatggtgcatcagaatctgcattttaacagcgttctctggtgatttgcttgcatattacagtataggaagcactagtgtagaagcaggtatctaagtgatgacaacccaccttctggtttcctcccccatcccccatattttaggagggaaataaattcacacaacagagaagagctcatcattcaataaggaaattttccaccaagcaaaatcacttgaaatgtttttactgatgactgtagcaatagtggattgtcatttgacaaaatcagtcactgagaagaaaagatactaaacacttagtagtgactgcataggaaatgttttgaaatagtaggacgcaggagtaaggatggcaaacattacaaagagtacagtggttgtgaccctaggctgtggcatcagatagatctgggtttgaatcctggttctgtcacttacttgttctatagccaaacccgagtcactgaatgtctctaagcctctgcattctcatccataaaatcatgagaataattgtacctaccttgtcgaagtgttgagagaagatttactgggatgatgcacataaattcttaaacatggtgcctagtagttggtaaatgcctcacacagattaactattccagtctttataattactatttaccacgagggtaggaagactctagctaaaactgtgaagtaatgatagaaggctgactctagttctttttgctccagctcatcaaatcaacacagttatcttggtatcttggcgagcttccctaggaatccaaatgcatctaaaaactttgataaatagccattagaaataaatctagcaacttagaaaatgtattggtagagacacgtgagcacagaatggcataatctttatgttatttgtcatggtttttttttctggatctgctgcctgataaatgttttattttcattcactcattcagtatttattgagtcctttctctgggctggccactgtgctggttgattgaaagtgaagcgtgcacatgggtactgtccttgtgagcttagagttaggcagttaggtctggcgtttagggccatggagacctgccagactcttctgaaaggacacttgatataggcctctccaagtgagtggaggcaagggggctgttcagtctgcccataccccgcttctcccctatctttgtgaggctggtaaaagctaggcacatcctgaagcatttgggcgccaagaccttcatggtgactcctctcccttcgaccaaggaatcttagcaagcataccatcttactagacatttgccaccttattggttctgattgaggcagtatgtttttttaattgacagataaaattgtatttaatgtttacaacgtgatgcttttaagtatatatacattgtggaatgactgaatctagctaattaccatatgcattacctcacgtcgttatttgtgtggtgatgggcagtagggttttgaagactagggtaaaatctagatcattcttttaacaaatgggtaaagcatgccttctaattcccagtcatgtcttgggggggggcagtaaattcactcaggtgagagctactccatacagtacttttctagaagctctgtgttacataagctattaagggaagcacttccaccaggagagtgaagttgtcagtgatgagtggactgggcatggcacgctctttgggacatgcacgctctctggggccccatgggcatctctctaatcccccacaagcagccgccatctctttgataagtcttttaaccttgtccttatgaagcagaaaacccaatttaagggaaacaatagtcatacccgtcagacaaagtaatacctatagctgaaaagtgattgtataacctaacatttaacttccagaaaattcaaagtataacatcccattccatctcctctggtctataaaaaccagccaaccatcttcacattggttgttataccagcctttattgctgcacccagagtattggtgagttggtgacaatgcgactggagatagggctgtcatttgctgcgctgagggtgtgaagatgattagaatcattaacacgaaggcactatgtgaatgctagagtctgaaacgttctgccactggtgtcagcagatgtcatcttgtcttgccagtgactggggttacaatcattcacccagaaaagaggacgatctgtgatgattagggtagacagaagcaaacggcatttattcaacagcaggcctcttgactccgtaggcatccgcagagcattctgataaggctgacatattttctgctggggtgtgaattcaggtagttactacaaggccttttggaattcctggccatctttctttcggagagtgcttagtggattctccctcaccagggtaacaaatgctttggggtttttcctcaagatattccagaagagcatccgttgatctcttggtgcatattttagagcaattatgtaagctatttataagagaacctagattcaatggctgtctgtttatttttggccttgacagtaaaattgaataccagaacggaaagattaaatattctgagaactctaatgaagcagtgtgtgtgctgtgtcattgttacagaaggctaacggggaacttagactctcaaaaacagcagaaacaactgctcactgtcattaaaaaaagaacaaaattagaataggtattttgaaagatagtgttatttaagaaagtggccagtgtggtggttcatgcctgtaatcccagcgctttaggaggccaaggtgggaggattgcttgagcctaggagtttgagaccaacctgggcaacatagcaagacccaatctctacaaaaataagaaaaattagctggacatggtggtacatgcctggagtcccagctattcaggaggctgagtttgggggatcgcttgggcccagaagtttgaggctgcagtgtgctgtgatcatgccagtgcactccagcctgggcaacagagcgagaccctgtctcaaaaaaaaagtaaatctcaggctccagttcttttaagagaaactgttcaaatcaccagaagatattactgatctaccatgcatttatttggagggctcttcagtgttagtgcaagtcaagaatgatggcattgctaagattcccataggcgtttccctaatgaatgctccccagtgggagctcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggccgaattttgctggtttaactctaccttccctataccaaattcgtaggaggcccctcaccttacttagcctccatcttctgacaactcagtccgtaaaatctgttcttagtcaacattttctttattattcatcatgtcctttagcctttagccctggccctaatttttatttagaatcatcttaaaagacatcttgtttgaaaacgtggcatctataacaagaactgttgtttttctagtttctgaagatgcccgataatttccctattttttagccttccaaaagaaagaaatatgtgcttctaataagcagccttatgaaaaaaatttacctaaacattatctgtcttgaacatttagtttcatgggtggtttcacatgcaaagaaatggggtttgtcaaggagttaatgtcatctgagtatggcctattgactcagccccagtggactttctcaaagccacccagatggtattccctctcccttctccagctgtacttacagcctgtagtctttgaaggcagagcccatgtcccaagcttctccttcatggggccttacagcatgcatggtacatggttgctggtgaagaacccatggtcctttagttggttggtgccagagtgtatcttctcttcctcctgcctctcctctcctgcttgctgctttctcttgtacaaaagaggaggaagagtggaagggaggggcagggggaagctggcctcctgtcagattgtccttcctagaccaagagaggcccagatccttccatctgatcatggggtctgggcatggaatcaaggcatcactttcagggtggggcagatggaatgaaggggtgagccaaggggtgaactgtgagagcatcttagggagaaaccaaatgccaaggcctggctgaccacccaataggccatcagtctgaatgggagatgatggatgtagaccactaggccagaggctgaggaaggaaactagagaaagactcttccaagagcagattccctaggtccctggggatctccagtgcgggtgacagggcaggcagttgctggggactctatagggtacagaggtgcagtttaagacactgtcatcacctagagcatagctttagctgcacatttcaaaggtgtggctgttcctctaggggcaggggagaaaagggcagagtggagatccccatgtgtttctagagctgcaaaggggtgccctaatcaggagctgtccatttgtgtcccctctccagcctcacccacagacaccgccagagaacttagtgggatgtgtggaggaggtctcccaaagtccagaattgctgaaaatcaagctgagacttacttccagaacctcaccatattcctctaacgaagccctttaaaggttacccagccatcagggtacacttctgtttgtgtttgtttgtttttaccaaatcacatctctggggccagagctctgaaggcaaaccagctcaagaggcaaagtagcaaaccagattcctgccaggggaacagttgagccagccaatgagccttttgcttgggaagggccagtcttgccaagcaaagggcagagtcagttctgaaatccttcacaggaaacaaagcttgtcttcctgccattctcattccagaacgtttatatctatttccttcctggtaatgtaaaggtaaaaatcaaatctagctaatatatcctttgaaggatggtgtctgcatgtcttggtgccagccaacaaccccgcacacaagcagacacagacgcatgtgcacttaggcctgtgctccctccatatatgaagactatggaaggcattcggctctcccagaaatcagaaaatgtgggttcattgactttgttaccattatattcatgttggttcttgtgaaatgaattcccgtagtctggacattgagaaacgtagagttctgggccctctggctaccaactagctgttgaaacagcctttctgggcctcagtgatctcagctgcaggggggactcctgtgatgacttgcagctcttaatatccactgtttttttttagcacttacctgcaaattgagcaggctgaagccacctgaggttggagctggagcattttaccttcaccatggagggagggataaagagaataaacagaacaagtgcctctagaaactcaggacttaaatacttgcctgagttgaaaggatgtttttgggtgtgcacctataggagctggttaatatcttattactgttaaactccacacaggaaaccttgacctactacttagcccggaggaccccagccccattttctttatccagtcacaatgggatgtttggagggaaatcaactaaatgatctcttcatgtctttttatttgagaatagtgaactcctgtgatgaattttctactgtcacattttgctggagaatcacctgttttgccttctcagttcacactgccttgtcttcctgttgcatttaaaaagaaatttttaatttgtttcatttttttttttactgagacagggtttccctctgttgcccaggctagagtgcagtggcacgatctcagctcactgcagcctctgcctcccgggctcaagcaaccctcctgcctcagcctcccgagtagatgggaccacaggcatgcgccaccacgccggactgactttttgcattttttgtagagatgggttttcactgtgttgcccaggctgctctcaaactcctgagtgcaggcaatctccctgccttggtctcccaaagtgctgggcctgttgcatttttttttttttttttttttttttgagacggagtctcgcccactgcaagctccgcctcccgggttcacgccattctcctgcctcagcctcctgagtagctgggactacaggtgtctgccaccgcgcccggctaattttttgtatttttagtagagacggcgtttcaccgtggtttcgatctcctgacctcgtgatctgcccgcctctgcctcccaaagtgctgggattacaggcgtgagccaccgcgcctggcgcctgttgcattttttaaaaaacattgtaggcccatgtgcaatactttatgaatcattttggggagggggacagtctacagccgcatagaaccctggtcctgatttttatttagaattaccttaaagacatcctgtttgaaaatatggcatcttttctcctttgaaaaagcatgaaggctaagtttgatggaaccagagaaagtgaagtcagtaaaggattaaaaaagaggaaaacttgtgaaccccctctgctagtaagcaaagcaggcacctggccagcattgatcaagagtggtagatgcaagacagacagctcacaaactgttccttcctttcaaaactgtgctcccaactgcctctgcaactgccgggtttccgaacaaaacttcacacttctgtctctgtcctttgccacattcacacacatgcttgctgtgaccacactcttcatacactgtctgttagtgcaacattttcctctctccctcccctggtgcccctctgctctgctctgtcacatttcatgtgtctgctacatgctaaatgtgacacaacattaaagggattttttttttctttgaccagtaatcttggaaaatatgatgacttgtaattgtcgtttttaaatttggggccctgtggtttgaggcaaggtcgctggggtaatggcctcagcgaaaggaggctcatgtgaaattggctatagaaaaattcagaccagcaaggagtgaggaagatgtccaggggtaggtgtccttgggacttggctgggaagaataaggccacggggtgttggcagttttgtaaataaggaatgacaggcatacttcattcttctgtgcattccttcattgtgtttcagatattgcgttttttacaaattcaatggttgtggtaaccctatgtggagcaaacctactggcgctattttcccaatagcatgtgctcacttcatgtctttgtgttacattttggtaattctcacaacatttcaaacttttttattattattatacctgttatgggtaatctgtgatcagtgatctttgacattactattgtaattgttttgaggcaccataaactgtgcccatataagatggcaaacttaattgatcgatgttgtgtgtgttctgactactccattgacctacgattccccatctctccctctccttgggcttcactatttcctggtatgtaacaatgttgaaatgaggcaaactaacagccctgtgatagcctgtaagtgttcaagtgaaaggaaaagccacatatctgtcactttaaatcaaaagctagaaatgatcgagcttagtgaagaaggcatgttgaaagctgagacaggccaaaagctaggcctcttgcactaaacagttagacaagctgtgaatgcaaaggaaaaatttgtgaaggaaattaaaagtgctgctccagtaaacacatgaatgataagaaagtaaaacagccttattgccaggcatggtggctcacgcctgttatctcagcactttggaaggccaagatgggaggatcacttgagcccaggagctcgagaccagcctgggcaacatagtgagactccatctctataaataaataaataaataaataaataaataaataaataaataaaaacagacttgctgatgatatggagaaagtttgagtggtctgaatagaagatcaaaccagccacaacacttctttaagccaaggtctaattcagagcaaggccctaactattcaagtctatgaaggctgagagaagtgaagaagctgcacaagaaaagttggaagccagcagaggttggttattgaggtttaaggaaagacaccatctctataacataaaagtacaaggtgaagcagcaagtgctgatggagaagctgcagcaagttatccagaagatctagctttgatgaaggtggctacactaaacaacagattttccattgatgaaacagcctttgattgaaagaagagataatctaggactttcatagctagagaagttgatatctggcctcaaagcttcaaagggcaggctgactctcttagtaggggctaatgcatctggtgactttaagttgaagctggtgctcatttaccattctgaaaatcctggggcacttaagaattatgctgccagacacggcagctcatgcctataatcccagcactttgggaggccaaggcaggaggatcacttgagcctaggagtttgagaccagcctgggcaacatagcaagactccatctctacaaataataaaactggccagttgtggtggtgtgcacctgtggcctcagctatttgggaagctgaagtgagaggatctcttgagcctgggaggtcaaggctgcagtgagccatgatcgcaccattgcactccagcctgggcgacagagtgagatcctgtctcaaaaacaaaaacaacaaaaaaagaattatgctaaatctactctgcctctgttctatagatggaaaaacaaggcctagatgatagcacatctgtttacagcatggtttactaaatattttaagcccactgttgagacctactgcttagaaaaaaagattcctttcaaaatattactgcttattgacaatgcatctggtcacccaagagcccagatggagatgtataagaagatgaatgccgttttcatgcctgctactacaacatccgttctgcagcccatggatcagagtcgtttcaactttcaagtcttgttatttaagaaatacattttataagtctatagctgccgtagatagtgattcctctgatggatctggggaaagtcaattgaaataattctggaaagggctcaccattctagataccagtaagaatatttttgattcatgggaggaggtcaaaatatcaacattaacaggggtttggaagaagttgattccaaccctcagggatgactttcaggggttcaagacttcagtggaggaagtaactgcagatgtggcggaaatagcaagaggactagaatttgaagtggagcctgaagatatgactgaattgctgcaatctcatgatcaaccttgaatgaatgaagagttacttcttatggatgagcgaagacagtgatttcttgagatggaatctactcctggtgaagatgctgtgaacattgttgaaatgacaacaacgggtttagagtattacatatgcttagtgataaagcagtggcgggatttgagaggattgactccagtattgaaagatgttctactctgggtaaaatgctatcaaacagcatcgcatgatacagaaaaatttttcacgaaagaaagtcaatcaatatggcaaacttcattgttgtcctattttaaggaattgctacagtcaccccaaccttcagccaccaccaccctgatcagtcagctgctgtcaacattgaggcaagaccctcccccagcaaaaagtttacaactcgctgaaggctcagatatcattagttttttctagcagtgaagtatttttaaattaaggtacgtacattgcttttttagacatgctatcacacactgaataagctacagtagagcataaacataacttttatgtgcaccaggaaaccaaaaaaattcctgtgactcgctttattgcagtggtctaaaaccgagtttgcgttatctctgaggtatgcctgtactctgattccgaggtaaaggaaggttaactggcagaacttcactgatacttttgttaggtaaacacacatctgtccccaggataattaacacaacgacagagaagggaggaagaaaaagagttagtagagagctagaaggggctggcaaaaggggaaagaataatgtgagatcatgaggcagaaacacatccatcccatggaggacctgtgtgtaagggcaggtggcccttagagcagctttctttattttaataaagtatatttctctgcactcatagagacaatacagaaaaacattaagaatgacacacacacgtgtgcgcacacatatgcacccagaatcagagatcactgcttccccctaacacagctgtctgagaacagtgccctggctggattttttggccatggaataattttccaagtccagcctgatcatctctctcccacagtcaatcctaggtggcaagaaaatgctggctactctggaaccagttcagggatgaatgccattgattgcactgctacctccatcacctacagagtgacagcatgtgagaaaaacaaatcacggctgatatgcaaaaaaaaaaaaaacaaaccaaaaaacaacaacaaaaaaaatccctctctgttccagtttatcacatgtacaatgagtctgtggggtgtctaacaaatggcctgccagcctcggtgtagaaaggggcagaaggcttgcaacctgatgtggctgcagtgggccctcagcctgcattttgttgagagtcctacatccagagcagattcaattttgaatctttacagtgactcttttcgaatgcatggttattcagcagattaaatcttaattgcaaatgcagcttcagcgtaggagtaccattgtgcttgctggtttcaggccatttttgctgagccgtgcttttccagaaggctgttacaaatttagaaagggggaaatggcgtttcatttgtcgattggagttttgttttgccgactggatttattttagtgtttgtttagaggtgccaaaaactgacgtccctggagagagaattgctcaatttttttggagaggttctctaaattgtccaaactgcacatagaaaacaatgtctgtggtccttctgtgagaggacaggcttgccaacaatctcatgtggtataatttttattaatttttcagagacccaagaagccaccgcctccatccgctcctgtcatcaaacaaggggcaggtaatgtacctttcagttccatcaaataaaatatgcgtctttctttttgcatatattcaaatcatcctcagtgtagagttcgggattcctggttcaagtgccatagattgactacttgggaagttacgatttggtctcagcaggcaggttttaaagatacttctgtttttcctaaaagataaacataccattaaaatgtgaccctgatatagtgtaaaaatctaggctcccaatgagaatgatcagaaagaattaaaacaaacaaacaaacaaacaaaaaaaacaagtttgggtttttttaagtaaacagcttttgaggagaaaagaactgaattgccctgtttctcatgtgcccagttgaaggtcagcttagggaagattgtttcccacaggtcatagcattgttgtgcgtatatagtgttgctgaattttcgatatctgtcccatgtggttaaccaaaatttgtactgacttcacttacccctcaacaaaaagatgtttttctagcaataaatacttttccttatgattcttgtttaattttgaagagtctaattcactttttttctgtgtagttcagatattcaggttgaataatataggaagaattgatgttgaacatttggtagcttgtttcacactggattctcatatataaaaagatatttcatatttcccggtagaactcctctttataatagttaaaattaattatagggaaaaattcctccatgagttattagttaagtagcattttaaaaaattaacaactaaaatagaagagaaagggtatttttagttctacacattcacaattatatttctataacagttaaattatgaataaatttcaagattggtttatttataaacttattaagaagtgatttttaagttcttttggcccaccaagttaagaggaaaaacttgaccccaaattcctttcccattccctttggcatagttgagaattattagagattaagtcctgaaatgggatgttaattacatcttttgctccgcccccatccttgtttgcattgagcagtttcattttgccacctagtggttctgcccatatattttattgtgctgaaattgaagcaagctatttatttacttttctctgaagacccctttccctgtaggccttggtaattgatcagagaccgtggagattagttgaggagtccaaggctcaggcagtctagaatgtagctaagattggattcttcagtataataggattgtcagttctttctgtgtctctaggaatgataccgacttcattattgttaggtgagtagattgtagcatggtaggcaaattcttacccttttaaaacaattttaccaaagtttatgatgggtctctgtggggcaaagcaggatggcatttaatgtttatagattactgctcatttatcctgcctgaatgatcgtgggaactgctttgtaatggggagatagatattcatattttctccctcgtcaactttccttgcgtttgattattttaccaaaaaaaaatcagatatgaaattgacagaaatgagatgtggtgattaatttgtagtgagtcattaagaggaattaagtaaaggatgtgtttggtggatattttttttaacttcttttgttctctgaggttgtgtaattgagatttctagtaccaagcacccatctttggaactggtcatgtaaagagtttgttaagaactcagcccagtccatacataagaggagtacttttgactggtttgtgctttagctatttctcaagtgctcttacatgcctgaggccactggcaccaatgaggaaaccccaggtaagggagcagctgcagtccatgtgggtaaaggctaagtgctaagtggtacatttgaaaaaatgtaatacttgaaggaccccaaatttggtggcataaaacaacagccttcttatgttcatggattctgtgggtcaagaacagaccatggctgggctggcttgtctctgctccgtcatatctgggacctcagctgggaatactgaactagctgaagctggaggatccactttgaagatgaatgtttccctcacgtgtctggctccccttggcaagggtgcctggaaggctgggctcagctggggctataggctggagcatctgtatgtggcctctccagggtagttgacttcttacatggaagttcagtattccagcaaataaagcataaactacagggacttttatgactcagctttggaagttatgtggtatcattcctgccactgattgaagcagtcacaggcccacccacattcctggcaaggggatgtagacctcacctcttactgggaggagtatcaggtaattccaggccctgttttaaaatggctacaaaatgggatccagattcctatgaaaccccctttttttggtagaacacaacattcagtggccccttatttgtaaagtttgataattgacatttatttatacacattctccacccccacccggtgatttcctgtgactatattgatgcctaaggaaatcaggcttaaatatcagaaaatattattagtggtattcttgtaaattaaggatacataggcaggtgaacttaatgacataggccagaaatgtcttctgctctgtttctaaacagctcgtgcttgccagataatgctaacgcccaactcaggggaaaaaatcttactgactttgctctacctgataaagatttaaatgctggtgggtgtaataattgagtacagaaaacattttgtgatcactattaccctttccctcctaggcaccactgagagaaaacatgaaattaaaaagatacctcctgaaagaccagaaatgcttccaaacagaacagaagaaaaaggtatgaaatcaattcttcattggcacttccagaacagcaggagctgaagctgtctgttacacggctagtccagaatacccacagaatttgcttttcctttggaatatggtgatcatggttttgttttgattgcttttacaaatcctattgctaaggaagtaggagagggttatgtggtacttcgtgggaccacaatttctcatcagatgaaaaataaccagtctagtcaattaacacattgctgctgtttcctgatgtctctaccatggccaccctctctgcaccctgaagtcggatgtaagttcctttagggcctggtatatatctgtcagtttccacttagcctgtccttcatgcctagtgtcccaaggtgctcattcactgttgatggatggatttggcatagtgaaattcacgtccagataaataaacaaatgaaagctcttttctttggtcactcatggacccttgactctgggtaacgttattacagacagaagtccttggtcaaggatgttggaggaggggagggtggcatggtaatactgggaaagcagcttggtccccagcgtctcctgaaggtggtcaggagtgtcattggcaggaaagtaggttaatgtgtgtcctgcaatcaggtttatgaacgcgtttgactcctaccattttgagagtctctcccaaagaattctgcatactgtagaaggactcattttattaggtgtctaggatttgattgatcacacatttttatgggaaaagtgctatgttattacgaacaggaggctgagcaaatcccattttaaaaagcagttatttttaagtcacaagagaaatgctgaattaatgaatgtaattatttggaggtgctccttggtggcctcatgaaattttattgtgaaatttgatatttgatatcagcctgccaaaaattttaccaacattgccagctcttaagaagctatacctctttctttcacagtgagcagttagaacttgacttgtggaacctcattgtgaaggccaggtctgtgtcacggattgaagaaaaaaaccagccattgagtatatactatatgaataactctttgtataaaagcattggtatggccaggcacagtggctcacacctgtaatcccagtactttgggaggctgaggcgggaggatcacttgagcccaggagttcaagaccagcctgggcaacataacaagaccctgtctctaccaaaaaaaaaaaaaaaaaaaaaaaaaaaaaaaatagccaggcctggtggcctgtgtccatagtcccagctactttgggaggctgaggtggaaggatcgcttgagtctggaaatcaagactgctgtgagctgtgaccatgccactgtactccagcctgagcaacagagtgagaccctgtctaaaaaaaaaaaaaaagtgtgtgatgtgaaataaccagacaccaccctctgtcctcatggaggacacatggctagtttctgggtaatagccaggctccgtgatggggacacttcctgcactagtccatgctgacatatggactaggcttacatgtgaacaaccaccctagttggctgaccaagtggccccacatctctggttccttcctctcccatgatcccttgttatatgccacagcgggtgagggacgtagaatccctggtcagatgcaatagggaagccagggaatcagccctacccggatacttggtttccctgttgggtcagcacaaactcccttttccattcatccagcaggctgctggagttcctgtccctgtcctgctgcaataggagaaatgtcccctgctttgcatttcaacagagcccttcctcctctggcccctgtgtgccataaaatgagttgccagcattcctgattggagcatatttccccacattgtggggatgagcataatagtacctgatgggtttatttttattttatttttttagagacagggtcttgctctgtcacccagcctggggtgcagtggtgcgattgtagctcactgcagactcgaactcctgggttcaagatcctcccgcctcagcctcccgaatagctgggactacaggtgtatgccaccatgcccggctagtttttgtagagacggggttttactgtgttgcccaggctggtcttgaactcctggcctcaagtgatccttccgccttgccctcccaaagctctgagattacagatgtgagccaccgcgcccagccctgatgggtttttttttttttaaccttttgccaaccatctgggcacccaaacaacatgagtctgtgtttgcaagtagaaggtgtcctgagtaccatcttacaagtaagcatagggagcctgcctatagtccgttgggcaactctctcaagttccatctttatcaagaagaatgtggatgtatgctttttatgccacacacggagcaaggctagttgggaacagaaaatatgaggttgtcactgaacactgcccccgttcggccaacagatctggcttcaacttcattctaatatctgtgactccaaaaagccttggaaaccttatacctgtgaagtcctagtttgccttccaagttcaaacttcttgtgcgcaagaagaatccagaactcattgttccctgaaatgctctcccttttatttgctcatggcccttttcagaggccagcctgagacgtgtcaggcctctttccttcccatacccagcaggtcccgtgggccattgaccaaacccctcagccctctgctgagccctgactccatgccagcaccacatacagctctgaggagatgaccagacttgggccctgccctcaggggctgtcggcctacaggctgtgccaaacatgcaaacacccagaaagtgtctgagcgtgtttgtaaagcgctgccctgtaatgctcaggtgaggaaggaaggaagtctgcctttgagctgttgggaagggaacatggcagtgtcacgtttcagccaggcttcgaaggaagagctggagtatgctgaaggtgggcggtggccagaagggcgcttcaggcagaaggaccagcatgagtgaaggtgtgcaagggagggaacagtgagctctgtgggacttcttctaacctgacaaagaataagtggtgctcttggccttccatgatcaccttcagaaatagcatcagtaattttttttttttttagcaggaaatgagtgatctgcatctaagtactgtcacttacactcgatctatctgttttctttaaacaatgatttaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatgaggactgggtacccagcatttaggccctgctcacacacaggggtttttcctgggccttattagaagcaaggccaactgcccttcagcctggaaatgcaggtggcgtgtccctctttgtccccctggatgttgtgccggcctcaagtatgtatatctcatgtgtggctacgacccctgaccctcactgctctgcagggcttctttccatagcccaggctccctctgctcttcactgtacagcctgttatggaaccccgagccaggaacgtctctaactctaagaccctcaacggctggggacatgctttatgcaggcatgtgttctgagatgtgcttgacagaatgcaaattcattcgccagctggctggatgcatgtgttccatgaaatcagagttggacattgtgtgttccagacctgagatacctaccacagagcaaggaactgttgaattctctccataagttcattgccagaactttctaccataatatgaaaatatatatgtattatatgtgttggtgtaacacaccagggcaggtcagtgactcagaggtctttaggtatacatgtcaacacacagtcactgaatttttgttcttatgagctaagttggcctggtgaaagttgcatgggcttcacagctcttgcgttggagtcagacagacctcagggctggaatctcagcccacctcattcatgggaggagtaggagcttggctactctatcctctcacctcacttttttcatctgtaaatagaggatgataatggaatgcacctaaataattcccaagtatgcaaatcaacattattttcattgttattttgattattgcctattgaattgggcacgctgcagtaagacaaaaagagctcatttactctcttaaagacaagttttaattagtggtaaaatacacacaatgtaaaaatttaccatcctaaccattttaagtgcactgttcagtggcattaagtacgttcacattgttgtacaaccatttccagaactcttttcatcttgtaaatctgaaattctgcaccctttaaacagtgactccccatttaccccctctcccagcccctggcagccgccattctactttctgtctctatggatttgactactccaggtacctcagtaagtggaatcatacaggattcatcttttttttttttttttttttgaggcagagtttcgctcttgttgccctggctggagtgcaatggcgcaatctcggctcaccgcaacctcctcctcctgggttcaagggattcacctgccccagcctcccgagtagctgggactacaggcatgtgccaccacgcctggctaattttgtatttttagtagagactgggtttctccatgttggtcaggctggtctcaaactcccgacctcgggtgattcacccgcctcgggcctcccaaagtgctgggattacaggtgtgagccaccgtgcccggtggattcatccttttatgactggcttatttcacttagcatgatgtcttcaacattcatctgtattgtagtatggctcatttgcttttcataacaatgacaacaacaaaaacacaactcccaggctcaaatgtagaggcaagtcgcaacgtgggctggctgcccagtcgatacagagctgtggtcatctcaggtgcgtgtgagcccattcaagtagcagctggttcacctgtgtcattctacaggcatctcccaaggtccagtccaacaattgcctccatgtgacaccccctgttgagttggtgaggcctctccatgttccaccctctactatgaactggcaatagaaggttctttgcacatgcacatattggggccacttgacagccttgatgaccttagcaaggatcatttcagtggtgtggtcagcccagaagctagtatatcagaagaaaaaacttatttaaaccaaagtgcttccgaaaagaatacgagctatacaaatggggaagatgtggagcagcaaaggttgcacatcactgaagccacaccctggcaaattctattagtctccaggggctacaaacatttccgttagctctataacaatttccaaaatattcctgctgctctttctaacaatctgattgaagagaagtggaattccaactgctgctttgccttctagagttgcttgcaactctctggttataggataggtacaggctttgcaagcctgggggaaatgtggcatcaccaccaaacttctgggctcacagaggtcccatttgcctccttcctctgcttatctcttctctgcctctgcgtctcccagtatccagtggttagttagaagtccaggccatgaagggagatgcatgagagaggttcgtgaagccagtggaagatgtaattgttcttaacagtgcgtgccatctgagcagcctgggagagggtggtcagcccccagccctccacacactccatggctgcctagctccctagacactggtttgcaggagggtgtgggggaggaaagccctgagattcctgcttagccggtttaagggagggcagtgcctgctctaactcagtggttctcaaacttcagcatgcctccgaatcacctggagaacttgttcaaagcagatggctgggtgctatccccacagttgctgactcagtaggtcttgggtgggcctgagaatttacatttttaaaagctgctgctgctgctgctgctgctgctgctggtagtggtggtggaatccacaccgtgacacccattgctctagattcttccaagttgttgacggtgctcgcccctccttgcctggctgcctctcaagcgcctgctcgtgcttcagatttgagagcccctgttagcatgccctcctctggaagccttcccttagatctcatgattgctctctcctccaaatgcctgccacccgtgtttagcctagtgctgggccccatgctgtgctacttgggatgcaaacacccccggacttctttaccagatttaaagcagatcaagagtgtgttttgtcatctccacatgccttacggtgtcgagcatatggtagtggctcatttaacaaacacttgttgaatgccatggttccttaaaagagggggaggtgccagtgcttatattttgttcaattttgcctctcctgtcgtccttcccagcctccgtacatttagtacatttagtacatttagtacatttagtatgcgtgtcttacattctaagtaacctattatgccatggattgccacacaaaaacacttttaaaagtcagagaaaggcttattgttccttggtacttaatgcactttatatttttttgctaagcgattacattgaacaaccaacctgtatattggtttatgcacttgttttcttctgccaagttagtggaggtaggaatgttaattcaaatagtcttgtgtcagtggtcctctggagaaagggtattgtgttctgtgtgaacccagatcttcgccaggatttacctgaccaggtgaatggatggatagatggacgattgcatgcatggacatgtagtcactgtaagcagctctcattggaagccaggcattgccactccagctgcagcgtccgggctcacgctgcttctcaccagccagtaatcttgctgccaagtgcggctttcagaggagagtaatttctttctctttaaacaggagctaacatctttcagaaaaaaggaatactgtacataagtttaggaaaagcatcatcactttcagatatattcacttaacaaaaaacgtattacagggccaggtacagtggctcctgtctgtaatcccagcactttaggagaccaaggtggaaggataacttgaggccaggagctcgagaccaacctgggcaatatagtgagaccacatctctacaaaaaaatttttaaaaattatgcaggcatggtggtacacatctgtagtctcagctactcaggatgctaaagtgggaggattgcttaaacccaggaggttgagtctgcagtgaactgtgatggtgccactgcactccagcctgggcaacagagtgagacctttcctccataaatatatatatgtgtatttatatttataaatacatatttataaatataaatataaatatatttatatatatataaatatgtattttgtatatttatatacatatatttatatatatttataaatataaatatatattgacatatatttataaatataaatatattatatataaatatatataaatatattatatataaatatatattattaatatggtaacataaaatcagttggacattgtatattttgtatatacaattaatatatatttatctattttgaaatatagaaaagaatattacaaatatatattcatatatttgtaatatatattttatatattgttaatataaatatttagaaatatatcattaatatatattaacaatatatatttataaatataaatataaatgatatatatttatatatttagaaatatataaacatataccattgatatataaatatatgttaacaaatatatacatatgtgttaataaatatattagtatattaatatagttataagtatacataaataatatatattattaatagcaccataattattaataattataataatactataattagtaattatattagtcctggtcagacccaggtgttccagttcacagtttttaggaattatatctaggaaaaccacagtgacatcagtcagcagtctgtgttcagcctgagcaagtggaaacgcacatgaaggctcttacagtgatcgctcccttcctcagatagtaatatacttgacctttagtaagaatgttctccccacttctagaaagtaagttcatgtggaatttcaacaggaagaaaagactttcaaaaatgtaataccagcattgatttaaaaattcaatggtgggctgggcacgctggctcatgcctgtaatcccagcactttgggaggcctaggcaagtggatcacctgaggtcaggagtttgagaccagcctggccaacatggtgaaaccctgtctctactaaaaatacaaaaaattagccaggcttggtggcgggtgcctgtaatcccagctactcaggaggctgaggcgggagaatcgcttgaacccgggaggcagaggttgcagcgagccaagattgcaccattgctctccagcctgggcaacaagagtgaaactgcgtctcaaaaataataataataataataataataataataataataataatgtgtattagcaattgaataaaaatgggttcctctgtgaaaagagttcctgagacttgggagaagagtccaaaagaagaaaaagaaaaacccaaggaaatgctggagagaggcaggctgcccttagctctagtaattgcatgcagtggaaggcagcaagcaagaaacctgaggggcagggcaggtgtgtaccctcaaaaggaaataattctgatagggcaagagatagaagcagcctgaccagtccaaagcaggcttgttaatcctcccaaactcagacatcccaaggcataaggattagtcattttcttcccaaagaatagagaagctagagcaggaccttcactgtgagttggggagctttgcctgtctcccgctgtagcacatgctctctgagtggccaggggcaggtgtcagggagccttgagttagagatgtggggagaaggtctgggatgaaggagaggaagtgaggccagcaaggatggagtgggagcagggcaaagttgatggctggaaggaagcacaggagatggtgatcagaaaggggaggttggtgcttacaaccttggaggtgggtttgtttggaagatgaaaacattcgcaatggttgtggccacaaatgtgggtgactgaagatgaatgaatgaaggtcatagaactgaagataccgaggaaggaggggccggagttggggatggatcacccacgcggccaccataggctcaggaagatggcaagagctggagtcagggaggccagtgttctacaagccagtgtcctcccatgggtgctggtgtgttctgggagttgatgatagtgacaagagggtttgacagtgtggtagcaggtggtgtgagcctgctggctctatcctctgtcgggcagagcagaattaacagcttttgctttggccggtggctgagaatgtcaggatggaagcggaccattcaatgagaagggtccagatatgggggagttggttgctatgaatcagacatcccagaggtcactgtccattgactttacatgtggaaacatgtgcccaggaattgctttcgaagataggcagttggatgatggacaccaggatgtgggtaggaggcccagtgactttccagacctatgccacttggagatgacctattgctttaaatgttaaacataccatgtggacttcttgtgaagagctggaggctatactgagagaattggagcataggataaggggaggggcagcacgcagtggaatcgcttttttttttttttttttttaaacctgtagtgatgctggagcactggatttcagagaaacactgggagttaagtgactgatgagttctgaagcattttagcttgaggcaaagattaagtaaacatttatatgccaaacatcaactaagtgcatagggaagggcagatgtctctcttgggaccaacttaagagcatggaagttaattttttctttaaatttaccaaggcatcttggcttaagaccttggggttatgatgtagcaggaaataagcttccaggtactgatcactccgtgaggtgtccaactcccatgcccaccaaaagaaagcattagaaaagacctctttgcttttattaggcataaactaatcaatccattaatcaaaaaagaggacgagaaagctagtgagtgtgtgcaatgttccctaagtcagcaggtaaactgaatacttggatgcttagcccatcattttgaattgggattactcaggtgttgtgaatttctttctaaagattcctagtgattccttgtgtgatttttgtgtgtttccctcctttaatacaaatcaggatgaagacttatctttggagaattcaggagagaagtcttggctagaaattacagaggttggcttggtgcagtggctcacatgtgtaatcccggtgctttgagaggcagaggcaggaggatcacttaaggccaggagttctagactagcctaggcaacatagagatctctacaaagttttaaaattagccatgcatggtgttgcatgtctgtagtcccagctacttgagaggttgaggtgggaggatcacttgagcctgggagttcaaggccatagtgagcaatgattgcaccactacacaccgtccatcctgggtgacagagtgaagccctgtctctaaataattaaaaagagaaaaaaaagcaattacagaggtggatgccattggcttatagatggtagttacaagcatggaatagatatgaccactgcaggagattacggagaacaggaggaggaaagagtagagacagcagcagggaaaatcactgcgtacagggtggaggaaggcctaggagccatccaaaagggtaggaggagtgtgatgtcatggaagctagaaggaggaagtgtggagcaactactgatcagcagtgctcacacctgggcgtgcatccgaatcacgggtgtttaggggtgcttgttgaaacacagattgctggcaccccaggtttctaactcagtaggtctgaattaaggcctgagaatttgcatttctcccaagctcccagtgctgctgctgctgctgctactggtcaggggaccacattgtgagaaccactgccatctcgagagccagggacacccaggctttgctcattagttggcccttggtgatcccagtcgagcaatttccatgcaacagttgtgggcaggagacagatttggggtgagttgaagagagaatgggcaagcggccaagcgtgggtagacttgtcttgtgagaaattggctatggaaaaaagatggagaatgggtgctagatatagattcaggaaggaaagaaaatttgtgtgtgtgtatatgtgtgtatgtgtatgtatgattcatttgtttgtttcaaatactcgttaagtgcctacctttgccctggccctcttctaggtagtagttaactatggtaaccaggcccacccactgcttgcttgggctttggggccaggcacactggggttgaaaccccaaccctcttcttagataccctgtgacttcgtgcaaggtgctcaccaccttgagtctcactcagttccctcccctgcaaaatgacaccacaaggcctaccttgctcaggtgtggagagtttaaacaaactgctccacctcaggggcctagctcattgcctggcaacttgagaggcacttactaaatctgtgacctccatgggggaggggttcctgcatcaggctctggggccccaagggagtggaaaagtgaacatcctccgggtggaagcatgagtggcctcccccagctgcagcaagagccaggacccagggaaggccagcaactgatggaaggtagtcccataggtcacaggcatggggggaagtaccttgtcatactttagggacatctgcatgatttgctgacctcattccacttgtacatattatcttctctcactctctttccttcctcccacacataaagtgaatcaaccatagtgatgggatttagcctcagcccaggctgagtcacatggattttcctgccactgatggccagaatcaggcagtgaaacagtaggaaatgttaacacctcacgcatgctttgtactaattggtttctagaatgtgttttccatgggctatgtctttgagtagtacggttcctccacacggcaccctgcaaacttttctcacagtcacatgatgatgaattctcgttcctccagacactgcccaagatgggggctcagcatccttaaagccccttgcgcctctttgagatgtcaagctgtgggtttgcaggcgacgtctatggatgtcatcatccttgtgccatagtggattgcagggcttgtcaggccctggatgggctctggagagaggcctgcttccagatatatttgcagagtctgcacaatgaacaggaatttggaggggaattgagtgagcactttcccatcaccttccagcgtgtcttcaccatctataaatagcccagcttgtttgtgcttatccagacaaggacgcacgatgcaaagggagagctgccaggaaaaccactctggtttctgcttcttgtgcccctggcctccctctgcttgtcccacatttaaatggtaccactttttcagtccaaaagttcctgtgattcctgggacatttttggctaccaggtgagtatgtggggactcatagcagataacagcagaacctttggatttggatttctgggaaagggagggaggctcctcctgccctccatctgaggagcaaaggaaactgggattactgatactcccattttgtcctttcctgatggaaggatccaagttccatgagcagtaacatccctcctggggcagaatgcttctgaaggactggctttgcatctgctatcttcacagatgggcagggccctcttgttgctgttcatttgagagaaaaacatctcttggagcataaaacctgtgcacacggatgctcacttacattattgccatcccaaatgtggtaggaaaagattggactggcttggcatgaggaactttccatctggttccagctctgccaccaatcaactaggtggccttgggtatatcactccccactctcagagcacaggacctctgtctgtaataaaatgggggcttcagctgggtagtctctactcacctttaacaatcagagctgaagtctgagatgttataagtaggcagccaggagagcaggaagggagcgcttacttgcgttggccttgtatcctcaggcacccgactggacagggccacagaggtaaacaatgagatgcagtagttttacactaggagggagtgataagcaaggttgcagagttggagaaagaaagaagataggttctcaggtgacaggtgctccaaaatcccagacttcactgctgtacaattcatccacgtaaccaaaaatcacgtgtaccccaaaagctattgaaataaagtaaaaagttgtcataaaaaaagaagataggataattcgagtggtttctctaggatctgcacatttgacatccattatcatctgttcccaatgcaatgaaaagtgatgaacaatagaggatgtgtggtgtgtgcctcagtggtttcctaagcacaggcaatggggcgtttctatttcttttcctttccttttcttcccagctttctttcctccttgtcaaattttgtaggcagttgaagcccaaacactcgtacctcctttctggggcacggggtggcggcggagaggggtgtgttgctgccaaaaagagtcaccatatggacttggactctggttcagtagcaatcggtagatttgctctttcttctttcatccttgctcacctccaaaaggtttgtgggttctttttggtatttttttttttgtggctgctgttagtgctactgctaatttacttgtttgtttgcttgccttggcttcctgtgcacttcaacaccttgtctgtaccacatgtcttggcttaactgtcccaacgcaggctaaattgggccatgccactggctgagttcatggtctcgagagatgcacatggtgcatcttccacattgccgtctgtgcacgagccccatcttatatcttgagtctgagtgggaagaacaggcccctctggataggtcgagtgcatgatttttgtttattagtagtacttttaaactgagagaggcaaaggtaatttacttagctggcagtgagccggggtgacacaggctgcctggcgtccttgataactcactgtctccaaggccagatccccagcctggaagaccagaaggctgactaaagcagcttcgagaaggagtcaagagcttgggctctggagttggacttaataggcccaattctagaccctgccactttactgcttttatgacccttaatcagcaagtgacttaatttcactgagccccagtttccttatctacgtaatgaaaacaaggttgtcacaggtggggttctctagaaggcataccctgagccagcatttaacatgaagatatgttttagagttcaatacctatgaagcaaaaaggaagaaggattgggcagagggagaagtcatgatgtgatactggctcaaaaagccttggccaaattcgtggaaagttttggagccaaaatggcccatctgagtcatcccatgttgggctgagatggctgagactttgataccatggggtgtgggctgccctggaggggagggagtgccttggctgaggaggctctctgcagctgagatggtccctggaatagctgacaactggcagctgcctgctgacagcactcccagcaggcagtaggggcaatgagcccttcactcaaggggctgcgcatagtaggtacctcaaggggtggttgtgaggattgagtatttaaagcatgcctgtaatcccagtgacttgggaggctgaggctggaggactgctggaggccaggagtttaaaaccagtctgggcaatatagtgagagccccatctctacaaaaattttttttaaattagccatgcatggtagcatgtacctgtaatcccagctacacaggagactgaggcaggaggatcactcgagtccaggaattcgaggctacagtgagctgtgatcatgccactgcactccagcctgggcaacagagtgagactttctttcttttcttttcttttttttttaagtgcttattctagtgcctggcacatggtaggcattcagtaaacagtagctgttgctgttgtttcttttttctttttcttttttcattctcaaagggggtgagctgctgttatttctatgggatcataggttctacttatacctggtgtggtgcttgggctcgtcagtctcttctctgtgatttaggttcctgctttagtaaaacaaggagacttttagccagtacttgcctatccaagtcatgtgtcctaagtgtccataacgaaaactgctaggtaaaatataagaacattgcattactttgatttaaaaatcagaaacaagtaagggcaactttcttctgatgtctttggatatatggtagtatctcctgacttctcttatgttctccttttagttaacagctgtaggcatagaaactcaccagacagaaacacttgcaggagcttgcaaattacaaaaggatgggctttttcctttttctctgaatttaataacatcccttttgccaaatggtacccacatgctgggcagactggggagaacagggaccactgaggggctgcatcctcattgggtgtcagccactccagacacatgcttcacagaatttcagaaattttggtatttttcagaactgaaattcattagcattgttctaagagtctataaatacagtgaaaggcatttccaaatagacattgtaaaatgcttgcacacccacagtctgaacactgtcaaaacaccagctgcagcttccctacttggaaggatcagaaccttttttaaacttcacctactgtgttttcaaaataggtttgcttctggtcctgtgtcgaagatcatttcaacttaagcctgtgtctggtgcttggcatgagggatcagggctcagttggagagactggagagatcccactctccttcctatcaacatgtggctggtgctttagaatctggggaggagtggctcagggatgattagttcctatttcttcaggatggtcccttgtggttcaggctatccgaccatctgtaaggggcctgcaggcaaatcccagagatgtaaaacactctcctgagtcagaagcccctccctgacaagggttcaccccaggtcacactaaatgccacttgagggacagctaccttggccaactttggagcataatagttttttccttttatccagtgccattagaacaatgctcctaaaactggggatagagcgtctagtagctacaagcaatttgcacctttgtttttcatttgtgtggtattctttataattttaacagttgcaaagacaaaatgcccttgtggcaacagttttccactgatagccgttgtcgttggctgttttttgtttcttatggtttctcaaacagggatgttgtattagtctgagtggcttaaccaacagaatttatttcctcacagttgtagaggttagaagtctaagatcaaggtagctgcagggtttgtttcttctgaggcctcttctaacagcctcattttaacttaatcacctctttaaaaggcccatctctaaatacagtcacattttgaggtattgaggggtttcaacttcaacatataaattttgagaggacacaatttagtccataacagacatatacatggggatctgcaagaatttttttgtttaaaaagcgttgacactatactcaagtctgtggtctgaatgtttatacctccccctcccacaaattgatgtgtcgaaatcctcactcccaaggtgacagaataagaggtggggcctttgagaagtgattaggtcattggggcaaagccctcatgaatgggattaatgcctttataaaagaaacccctctcccttccaccacgtgagggcacagcgagaaggaagctgggtcctcaccagacagaatctgctgacatcttgaccttggacttcccagcctccagaactgtaagaaataaatttctgttgtttataagtcatccacactatatcaagaatataacttatccacaggttatttcctaacgtgtacaaggcccagaaaaatcacaatgtttgcttattcatttagttaaacactttttggcatacataaatgtataaagcattgtactaggaggaaacaaaagtgacaaaatcccattctgaagaataagtggggaagattactgggtacatatataaatatgaagtgctgtgataagggttgcgatacaggggtgtgttgcaggaaacacgaggaagagagatggatctctgagtgctaaaagggtgagttacatttgctcaagtcaagtgggaagggaaggaattcacaacattggccagagacatgaaatttggagtcaaaggagatgatgaaatgtcccagaatttgccacaactcacaggaccatctccactccaagcccaccccagactccaacatttctctgatgttgaaattatggaacaggagctctagatagaacgcctctcggaggtgatcctgttgaagctagcccaccagtcattttgttgatgaagcactcaagttccagagaggttaagtaacccggccaaggtcacacgggtgatgaacagcaggtttagatgtagcacacctggcctggatttttaagtctagggttcataactccacccctggcctgcaaaccagttcccgggagagatgacctcgtgggccacctactgcctgggtggttcttaaaggagagtttgtgaggcaggatccaggcaatctcagcttttaccttggtaatactattggagagaaaggagagagaacatgagctgcctgaattagataagcctctagttgctattattaagagtaaactttaggccgggcatggtggctcacgcctgtaatcctagcactttgggaggccaaggtggccagatcacttgcggtcaggaattcaagaccatcctggccaacatggtgaaaccctgtctctactaaaaatacaaaaattagcctgatgtggtggcacgcacctgtaatcccacttactcaggaggctgagacaggagagttgctgaaacccaggaggcagaggttgcagtgagccaagattacgccactgcactccagcctgggtgacagagtgagactccatctcaagaaaataaaataaaagtaaactttaaaaggaaggaaaaatctacctataatcttatcccagagattactactattaacattttggactatttctttcttgtctttttcctatatatatgattttgtttgtttttcaccagttttccgtagatgtgatcatactgaacagcatacaacttcagatattgagggaaaagtgcatttattgtacaaatacataatgcattctcatttcagaaaatctggcaaatgttcactagttccacagatgttttttgagtccctgccatgttccagctactgaactgggtggtggaaatcacccatcagactacccaggaataaccactgtaaattttcttccagtcttaaaatcgctcttcctaatatgtcaggagggcacgtgggtatatgtgtgctgctgtgtgtgttgtttttaacctgcctttgtcccttaacattgcaacgtaagcattcattcttgttagtataagccatttataaacatcgttcagatggctatataaaagtccatcaaatatcatagtttattcaagtgttttcctatttatgaaagattctagttcttttcagtttttcttcattacaaataacactgtgaaaaacacactgatgcataaaatccatttgggaggtggaggttgcagtgagccgagatcacgccactgcactccagcctgggcgacagaatgagaccatgtcttaaaaaaacaaaaacattttactcttttatatatagacagagagagagagagagtacatatatgtgacatatatatgtactatatataacatatatgtactatatatagtatatatgtactatatataacatgtactatataacatatatgtactatataacatgtatgtactatatataacatatgtatgtactatatataacatatatgtactatatatacatatatatgtactatatataacatatatatgtactatataacatatgtactatatataacatatatgactatatataacatatactctatataacatatatgtactctatataacatatatatgtactatatataacatatgtactatatataacatatatatgtactttatatatataaaagaatagttgagaatgacaataaaaggaaaataagagcagtaaagtaataaagcatagtaatgcacaatagggtcctctaaagtttctggagacgggctcacatttgattggaagcttccagctgtcaaatcgcagagggaaacagcagctcccagattgacagttaccataatacacaaataagccacatgttcagaaactgctgagctgttctgagatacatgtgattaactcatgagcaaaacttcatctttctgccagcagcccctctgacttaaccccagctgcccacagggtatcacctcaaaccatctttccctcttgactggaaaaaaaaaaaaaagccaagtagagttcactaaactcactgcctgagtgctctctttctcctgggcaggacatgtggtcttataagttttgatctttggtgtgtttcaaaaaggacagagctgtctggttgtgagtataatttgtgtttagtctgttattttgaaggatggcagcacccaatccttctgggatctgtggatcccaggtaatgatgtttaagggtccccaggaatgtatttctttatatctggggaaaactcttaaaaatgaaaatgcatttctgctaataattctgcatttctgaaacatttcattcaggttaccttcaaattagtgggtgctggggccctgacagtgaaatgttttgaaataaatgtcctccatcctgccctttctgttggctcgggatcagtctgaggcaatggccctggtggggcccaagcttgggtagccaggggacggagagggagtctgctgtggaaacctagcctaggggagcccacagccttaggaagttagggtgaggcaggaaataaaggtccttctctgaagcctaagctgcttctcctttccaagtacaggagttcatgctctacctgaacttctatttcagcctagcttggaagggcccagccagcatcatagcacacactcccaggacagtcttggagctgtattttctcttagtggaggccaagccattaggcctaggcctggtccctggtattcttacccctgcccctcctgcggtggaggatgcttgaggttaagaggcagtgttttttgcttgggagttgaggaggactcacctccttccattggtccttttctcccatcacaaaaatatgcatgttgtgccaaatgcgcccacaaacactcccttttttgaaacaggatctcactctgtcacacaggctggagtgcagtggcacgatcacggctcactgaagcctcaacttccctgggctcaggtgatcttcctgcctcagcctcccaagtagctgggaccacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccctcggcccctcattgcctcccagacaaaacaagccctgtagtatccggcccagcagtcaggtgttcaccaaccttgccagcctttgtcctgtcacttctctctgaggacttcaggctttggtcccgggggacttggccacactggcactctcacctacactggagtcattgctcagtcacacctcttaggaatatgtcctctctcccttttcctccaaggctcaagtgtaacaccacctccttgcccactaccctctgcctcacagatctcctgcactgacccactcctttcttctaataggactgtgacacctgcgtcttatagcctaggccatgtgtacctgtggctggctggctgtctctcccatttagaccacaagccattccagagtaggcacacctctgaatacccacagcacaagtggcacatgacaagtgcttgttgactaaatctggtactactcattgtgaggtgtaacttcaggccatggtggccttcggggcggtgagatggactatttctgttactttgctgggaacaactgctcagcttctctctctcattttatgggcaaggatcttttcctatttcaccgctctcatagcccttggataaactcgtttgtgactcatccccccaaaagggtgcaaagagctgtcttgtggagtaatttggaggaaccttctgtttgtgcatgagaaggctaggtttctctcgtcatcttggaggcctgttcccatcccatagagctgctcctagcccagatacagagggaagtcattcgtgtcctgatgagcatggggcacccatccaggagccgtctaatgttacaggcctgagccccagcaccagcattcaggccgccagatctcaactcgacaccttgtgcctttcaacagcctggctgatgccacaaccccaggccagaaaacctttttctcaaggttgaaagtagctgacctttgacaagcagcattggctaaattccttgttccttaaaaggaaagctcccagttatcattagccagtgtttatttggccgcagggcaggagcaggccctatactgcaccctgtgtacccagcaggagggtttgtggctggaagtacatgggcgaacagtcattattaaaatagccatttttgaaaacgtgtgctggagagggacgcatccagcctgtcagctggtctgcaccccatctcatgtggctagacagctcgttggttctctggctccctcacaggcaacagtgccatccactccacaccagcacactccttaacgtgtgcagcaagaaaactgacagaatgacaaggacacacaccaattattaaatgtctgggcttgtgtttttaatgtaggggtgacagtccaaagattgacttggccggcagttcgctatctggcatcctggacaaagatctctcggaccgcagcaatgacattggtgagtaaggacagtgttctcgcttctctttgcagagttagtaaagaacctcagagcctggcttgccttcaaccagcatgatgagaagtaataaagccattgaaatgccaggctggcacccttgcttggctttaggtgttacagttttgtaaagaagggaaatgatggtgctttccacattaaaacacaatgcctgggacctttcccctccctaggagaaattccttacaagatctaatgaaaagaaatgatgaataagcctttttgtaaaaagtgggcattagcccttatgttcacagtttccagtgatttgtgtattttgtgtaaaaaggtggatggatgcaaatgtgagatggcagggttcattgttgatacagcacttttgactgagtttcaaatgagctttggtatggtaattgccacttagttcagaacatgagtgagttttcccaaggtcaggataccaccatgtgataaatgggagggagctacagtctctctgggtaaataaaagtcagaggtccttttggaggtgtacgtgagtgggtgtgaggccaccggtgtgctgttaaggccactagtggtctgacctgggtgacaacccttttaagaagtccagattcagggactaattttttcttattattttattttattttttgacataaaggccatttaatgatagaaatatataaaaataatcatattgtttagcaacaggctatcacatttcttgggaagaggaaaatgacctgctttaagaaaaacttgcaaccatgtgcaagtcttcatttcaacatatttttccccatccacttaagcatttatcctttgagttataaacagtccaattacactattttaaaatatacaattaaattattattgactatagagatgctattgtgctatcaaatagtaggtcttattcattctttctaactatattttttgtacctattaaccatccccaccgcctccccaccccagccctgtactacccttcccagcctctggtaatcatccttctgctctctaccgccatgagttcaattgctttgatttttagatcccacaaataagtgagaacatgcaatgtttctctttctgcacctggtttatttcacttaacataatgatcttcagttccatccatgttgttgcaaatgataggatctcgtttttatggccaaatagtataaattttttttagctttacatcttctgtttgtacctatcaaggtcataagttagcattctctcgtattctacataatatagaaggctgaattttaaaatttactttgttttaattgaactttttattttgaagtcattgtagattcacatgcagtcgtaagaagtaatagaaatctgtgtaccctttactcagtttctccccaatagtaacatcttacagaactatagtacactgtcatgactaagatattgacattgatatgatccaccaatcttactcagattttcacagttttactagtacttctgtgtgtatttcgctctatgcaatatatatatatatattttttttttttttttttttttttttttttttttttttttgagatggagtcttgctctgtcacccaggctggagtgcagtggtacgatctcggctcactgcaacctctgcctcccaggttcaagcgatcctcccaccccagcgtcctgagtagctgggaccacaggtacatgccaccatgcctgactaatttttgtattttttgtaaaggtggggttgcactatgttgcccaggctagtctcgaactcctaggctcaagcgatcctcccaccttagcctcccaaagttccgggattacagctgtgagctaccgcacccagcctgcaattttatcatacatgtaggtttgtgtatctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaagtacttcccctgtttccacaagctcgtttacatcctcagcccttgagaagcccagtcaggaagcataacctgatagcttgggctgatgcaataacagaaactctggcctgctgtagcttttgttctgcttaaagtgcaggcagagcagagcagagcagtaattggctgtgaatgaaaggggattgtcagaatgagcctaagttccggttctaccaccgcagtttcgtatttgggccctgttttaagccagggtggctggttggtgaaggtcatgtgcgacctcaggaggctgtcttgtcacctccctcatgtcaataggaagggaggtattctccctcctccagaatatacaggataatctgtcttgcttgctaagagcattcacctttgacctttgcattctttgggtctggagatgtctatgatcgctatcatgaaaatatgaatcacatgtttttcagtctgatgagctagtgtggaaatattgggggtattgatgggggggcgggttcacctatagaagcttttcatgctgtggaaactaagcacagttgcatatatttgggagcccagaaatagagtactgaggtttggttttctctctctctttgccacagagacattaatcctagaaggctatatcttctcaagttaatggtatttttgttttgagatagtcttgctctgtcacccaggctggagtgcaacagtgcaatcattgctcactgcagcctctaactcctgggctcatgcaatcctcccacctcagcccaggagaatcgcttgaacccgggagacaaaggttgcagtgagccgagatcacaccactgtactccagcctggggaacaagagcaaaactccatcttaaaaaaaaaaaaaaaggtctccaaaacctagtaatcattttgtaatgtaaaacgtccccttagggtgttaaatgtgtgtattgttgtacaccattttaaaaaatcaaggtccacctggactttgatctgtagctgattacaaccctggtgaaacaataatcccaaagcgttagaaaggattaagagtgttttgtaagcatgtttggggtagaacatgcctttataacttttaatcctcgttgaggtacagtgtgagtacaggagctgtgtgtggaatatccttgtgttagaatcattctgctaatatagtggagaacaaaccctcccccttcatctcccctcttccatcgtcctgaggttctagtgttgaaataagagcagtgagagcaagcaagagtaaggaaagaaagaactaatattcactgggtgcccactaaatgttttgtctatttttttctcaccgtccatagccctatgaaggatgtgtaatgactcatgtttttacagtgaaggaacagggaagaaagcaagctggggaaactgagcaagattatctggctagtaagaaattggagttgaaggccaggcgcggtggcttacacctgtaatcccagcgctttgggaggccaaggcgggcagatcacctgaggtcaggagttcgagaccagcctggccaacatggtgaaaccctgtctctactaaaaatacagaaattagctgggtgtggtggtaggcgcctgtaatcccagctacttgggaggctgaggcaggagaatcgcttgaacccgggaggcggaggttgcagtgagccaagattgcaccactgcactccagcctgggggacaagagcgagacttcgcctcaaaaaaaaaaaaaaaaaaaaaaaaaaattggagttgaagccaggtctctctgacccatgagcccaaaccttctaggtccacatcagcatttctcaactgctctccccaaggggacatttggcaatgtctggagacatttttgactgtcacatcataggggtgggggtggagatgctactggcatctagtggatagaggccaaggatgctgctaaccatccaccagtgtgtaggatagcccccacagacaacaaagaatgacccagccccaaatgtcaatagcaccgaggcccagagagcccagtctgtgttaggaacaggaagaggacaggcttcccctgcaagtgcaacttgtgttccctggagtggcctgtctcatttcctgagaatctctataaaacctagtttgaaaatatttcatatacaaaaaagtaattatatttgaagtaattaaacatcaaccaaggacatgactgtgacctttgtgagagagaaagaggaaggggggggagagagagagagaggcgagagaagagaggggagaggggccatcttaaggcttgcagcaagtgaaatgataccatttgagtctgatttcaaatagaaagagtattggatttgtgattagatatttgccaaagatcaactacccagtgtttaaacgggtattacataaaaggacaataacaaatttgatcaatactaagttctaaatctgtactctgtatggtaaagttatacaggagagcaagagagagcaattgtaatagcgaccattaacacaacatttttgtgaatgtgacaccaaatgtctacaaacaagtgattacattcttaccttattttgcaatttctacctttcatgataataaatcacttctaagggtttctcatacaaattttgaggaaaaattcagatctcctgacttggggctattggtttttctgtcctgtttttaaaatacatattttaaacttccccttttggagccagagagccagttattggtccttgcagcatgtcagatcattgagcaattgctcaggttcaataaaacaagatatactgtgtcctgcctgccattaaaaaaaaacaaaaacccatgaatgacacttggagtgttccagattgactactggctgagcgtgtgtgtgaacaacagccgcgccttccagctctctcgggattagttgctcagacatgagaactttcactgaagagccacggctggctcctacagacactgtctccttactggcaaccttcagacacagcctttgggaccaaggacatggttgatgttacctgtgctgaagaacaggagatacggttgctactggtctacagtcaagtctgcatatgacgggctgcggtgcccatgtgtggacgtgtgcagctccggtccctatctagggacacaaatcgtgatcaaacttaaatttttgtcaggagtagctgaaaagcactatacatttctcaagtgtgatgacagaaagcaaaagagattgtgctgagggtcaaacgctttatacaaaggaagtgaaacaggttgcgcttctgattgatgggtttttaacccaggcaatcctctgagcattttgggttccttcctcgaacttacagaggcgtagctaattcagaacagcttctgtggatggccttctccctgcatcgcccttgagccctcccctggttcccagcctctcaggctcacagtggaggtgtgctgctgaggaaacaaggtcaagttggcaaccagcactcatttcgaaaggcatcctccagtcctacaggagatggtccttcagggccctttgaagggcctgatcttgggtgtaaaatgagcatctccacttagactttctcagtcaaagatgttgatcctcaccagaaccgaggtgctcacctctgcctgtgcaccttgcacagggcggtcctgctggcctttggtggtccatcacggtggctgggtttgtgcttagttatgagggtcttcacgaacatcttttaccccataacatcccataagcgcaaactcagtaaacattgaaagtgcctgtaggaaaagcctcacaaatgctatagaaacagggggagattacgtcaaagtggggacatgatggcaaatgttgcagaacctcactgcagcagtgcatttggtggtatgaattattccaatatacagagagcaaattagtactgtcctacccaagtgctctatacccaccagcctgcaaaatagctgacctgagagaggtggagggacatttagggagcatcaattcagatggctgttggcttggagagggtcacagaggctagtagctgtgtggacttgcaggcagccccaaatgctcacctatgtgcagagtcagcatgtcctgcctcccctggtaatgtggtcgcctgcatctctgtggccagcgctctcgttcatcattcagtctgatggcttgagtgcctctatgtttgctacatgctgagaccgtattctagtgccgtattctggaggtactgggtgtacctacagatttaagaatgcaaatctggaggtacacccagtggattcaaagtagtctcatagaacaaagagacttatatagtgacctttgctgcatccacagtatacaccacagaggtctctgaactgaaaatgaatgtggaagcaagggaacaggtgatgttcagctctcagatctcacatggcatttatttggcttgaggtgcccccctccccctgtcccctggctgtgggctcatggattggcagagcccagttatggcttccgttttacttgcaaatatccagaggaatgtacagtctaccagaaaattgtgctcaggcatccctttgtcacattaaaagcattatggacacacgacattttattaagtattttgttctggtatcactttattaagtaaattatcaaaatccttatttagccatggactctcattaaagcatgttctggaaaccttggccaaggttaggagcctgtaaagtttgattcattgcaagagaaaagtgattagcagttggagagtgacattgatgggccccattaaaaggtcattggatgtggtggtggcaagcgaaggttggagttggaggtcagcaggatgccctgatttagaaccaagcttacctttgcataacctatagtgacactctcttcatctccccacgccttagccatgtctccctgaggttcatactgtttggaatttcacaggctcatttatcaaaaaaaaaaaaaaaaggctttcaatttgggagacggcttgatttttcttttattaatgatgcacattcaaaataaacaaatgccatctcctactggaaagggtataatctccaagtgtaaaattgaacaaatttagcttaatgggaaactcacaatgttgacctttttctcagtgcattatgactggtgataaccttggcgcagacacgtgccagttcttttgaaaaccataggtccagctcacatctgcaaagatggaaggtggcgggaaagagaaatgttgggggcaaggaaaaggccctagagagagtcaggcgttgaagcagtggctcaggtaaaaacttaagtgtccagaaatgtacaattagcagattaacttttttttttgatagagataggattacttgtaatttttttcctaagaaaaagtcatggagtgtcagatttttcagagcactttaaatcctttttaccttctcctgatgtttacaaatgagaaatagctcatcaagttacccaggctggtgaatgagagcctgccagccctttctagcagttttgggggactcttgtctctcctagggtagtaaaaagcatactaggctttgagacagaaggtttttcctcctcaaattttgtagtaagtgtaattttggcttccatgtaattctggacattagaatattattgtctcacatatgcattaaaattctatattatgagtatcagactgctcttttttttttttttttttttttagacagggtcttgctctgttgcccaggctggagtgcagtggcacagtcacagctcactgcatgctcaacctcccaggctcaagcagtcctcctacctcagcctcccaagtagcagggaccacaggtgtgcaccaccatgcccagctaattttttattttttgtaaaaatgcatctcactgtgttgcacaggctggtcacaaactgctaggctcaagcaatcctcccacctcgcttcccaaagtgctgggattacaggcatgagtcattgcacctggccctgctcctcttatatctaaataaagtgctgttaaagaagatgaaatgacccatacatcttgctctccaaaaagaaatgtgcactctgctctggctgctcatcccactgaagctgaccatcaagcacaccattgtacctccttggatcttggtttttcatcattaatccaggggcttggatgacatgatcataaataacccaattcaggcagtgcatggggtctcattcctgtaatcccagcactttgggaggcaggagggatcacttgaggccagcagttcgagaccagcctgggcaatatagggaaatactctgtctctacaaaaaatattaaaaagaaaggacccagcgcagtgtcacagtctatgtttctctaaccctgtccatttcttttagctgagttttctagacattgagaaaactgctgttttggtagcctctgaatcctctttgaaatgaagcagcttattctttcctttgtctctttacttcattttctttagttctgtcagttcttttaatctagaattgataatttggccctttataagatctaatctaggggttttttttttggcttaatgattttttgcttttaaatgatttgctggctatatggagatttaagaaattgttaaggggttatgaacataactatttttttttttatttttagtgatggggtgttgctatgttgcccaggctagacttgaactcctgggctcaagtgattctcccaccttagcctcctgagtagctgcgacttataggcatgctactgcacctggctcatgagcatacctttttgtaaagttttaaaaagtactcattcatcttttaaaagaattattttgatttttttaacccaagttattacggggaaatgtaaaagagtaggatgtttgccctcctaaataagtttgagatcctagagaaaaccctgacatagatgcaagttccaggttgcaagttctattttcaaatcagttggttagtaattctttgcttccagtgacattgaaggaggtacccactaagttgtttggtggtagaccattaaaaataataattcctggtgatgctagactacggtctggtttttggtatataatttgcaaggagttcagagaattgagtgacattgataacaaaattatttccgttctggccgggcgcagtggctcacacctgtaatcccagcattttgggaggccgaggcaggtggatcacgaggtcaggagtttgagactagcctggccaatatggtgaaatcccgtctctactaaagatacaaaaaacttttaggtgggtgtggtggcccatgcctgtaatcccagctactctggaggctgagacaggagaatcgcttgaacccgggaggcggaggttgcagtgagccaagatcgtgccactggtgccactgcactccagcctgggtgaaagagtgagactccatctcaaaaagaaaaaaaaaaattgtttccatttaatctactttttttttttttttttttttttttggtgagacagagtctcactctgtcacccagactggagtgcagtgacgccatctcagctcactgcaacctccacctcccgggttcaagcgattctcctgtctcagcctccagagtagctgggattacaggcatgggccaccacacccagctaaatgttttttgtatttttagtagagacggggtttcaccatgttggccaggctgatcttgagctcctgacctcaagtgatccacccgcctcgacctcccaatgtgctgggattacaggcatgagccaccacacccagcctccattccatctacttctatttaagtgaacaaattttcttggcacttacgtctctaaaatgaaaaatagagagttgataccaaaccatctcttcctggtattgagtgataatcatacacacatgaagtgtttgagggaaaagcccaataaaattctgttttgtcatgcttaaaaattatttatcaaaatgtgttctgatcatttgtatactaataataatgtaatgagaactcaatccaaaagaaaaataatttttacacttagagtcttaagatttcaggaaagaaaaaatcttaaacttcaatttctatacatgtttttacaatagaaagatgataaaatagttaacaacagacttgaaaatggattaggataaaattcagcagtaggggttggaaatatgaatttaaggaggaaaaggaaggatgtaaaatttccaactgttaaaatcttatgatattttaaaatggatgatggtggtggttaaattgctgcagtattcaaatatatattggatatatttaagaaatctatgtaagttatattttaaaatctcaatgtttagaatataacagaaattacatcctttgtgagtaaaacttacataaaagtttagatttcaacttgatatgtgtgaggaggatatacaagggtttccaaaattattttagcaagtacactggcttcataaatatatcattttatacttacacaaacatttctatggattaatttctagaagtgacactgatatatctgaaggtgtacacatttacattttgtaataggtattgccaaatggcatacagaaaggttgtgccaatttatgttcctgtggataatagtgtaactactgtttccaatagagaattacattatttatcagatcactttgcatagcaaatttgggcctgtagtgagcaatttttaaaggaatgcaaatgtggagagctacttttccccacttagcattgcttgtcatcaatccaagtgaatcactacctctcctcgaagcaagactacagtaagacgtgtcccccctttctctgatctaaattgggtccccatgctatcattgctaatttcaccttttatcattctttcatagtaactaagagaatttgtaattatccatacaaaagcctgtctccctcagtgggttcttagctccatgtgggcagggaatgtggctattttccacccctgtatccccctttgcctagcccagtgcctagctcatagtgtatgctcagaaaaatagccactgaatgaatgggctgagcgtttaagtgaggggaaatatcaagatgcaggatcataatacacaatcttcattgccactagccatgtgtgactattaaaatttaattaaatagctatacttacccataatctatgcactctgtagccacgtggggctggtggctacgatttgaatagtatagattatagaagatcatcacagcaagttctactggacagtgctgatataggatgattgtacattcattttcaaaactatccctatgcttggcacaaagtaaatacttaagaaatgtttgattgaattaatgagcaaataaacactgtatctccctctcttattcttgagctacacgttttgatgtagaagttgcttgtaccaaatagccaaacattctcttaacttgcctaacacattacatttcttgccacagagtgccttgaagaagccagccccttttcctgcccatttgaaaacacatttgaataaaatagaaaaaaaacaagcaacgttctgtagtggaaagaatcccttggatgtgaatctgtgtgtgggccctgttacttgttggcagtgaccttgggcatgttttctaacctctggccctccatctctttctttgtggattatagtaatgcccacacagcatggggttttgtgtacatgaaatgagggtgtgtgcatgcgaagcatctagtaatggcatggctggcacatggagttcaaaacagtagctcaaaacttgtttatagcaaggcatggtggctcatgtctgtagtcctagcactttgggaagctgaggcaggaggattgcttgaggccaggagtatgagatcagcctgggcaacatagcaagatctcatctctaccaaaaaataagacaaaacaaaaaataactgggtgtggtagctagctaattgggaggctgaggcaggagggttgcttgagcccaggagcttgaagctataataccatgagctatgatcacaccactgcatgcactccagactgggtgacagaacgagaccctgtctctaaaaaaaagaaaaaccaaaaccccctaaaacttatttattctcagcagcttgcgtcctgcaaacttcacacctggattataaatgaaaacacaacagctgatctcctatatccttacacattttggagggcttattttcctgcagaatctaatcattgctaatcatttcagttagtgagtcagctaacacaggtgctcatttgacccctccctaatattgggcccatcttgatagtctgcacagattttccacactagtcaaatgactgaggcatggagcgagacttcctcctcccattcagactacctcatggtgtttctgcaatgcggagaaagtacctgcggccctgtgggtttagagttttctcatcttagaccttggaaaaaaaaaaaaaggtaggggaggggggatttctagccttgctcttagattcttgtttccaaatcccacagctccgttaatggtgtatgaaaacagaattctatctgcatgatttgaaagggttttcacatagtctctcatttacgaaagaataatcttatgaagctgatggctcagataattctctcatttttttcctgctggaaaatctgaagcctagaaaggttgtttgttaatgtatttaataatcattttttgaacactcgctgcaagccaggagtgatcttaagtccagggaaacagagagaaaagccatagcttcttccctggctggtgggggaggcagagaagtcaacaggaaatgtcagtacagggcactaaatgccgagatcacgatgatgggtgagtagggatgcacccaacccaggtcttagggtgcagtctggcttcttggaagacgcctcagttgtggcactgaaggaattagtcaggagaggaagccctgaagggacatactcagatgggggctgtacacctctctggtggcagcatgtgagtggtaaggggcttgaagtgagaaatctattaacagtggttccaggcaagaaattcagcggccttaataatctgagacagggtgtggaggagaagagatggcttccagagatattgggaggtagcgacattgccaggttttagctgtaagcaaacttatatcctaaagctctgtttaaagtgcacagcaacatgctataatgaatgcagagaacaatttaggagctcccaaagaactctgctggtgacagctagcctgacttagccttttgactgtttctcctctgtgctttcagtggatgtgctttacgtcacctgcggtcactggtaccattgctcctatccatggaaaatgaggctacattttctaattgaaccaaatagagtgtgactgaagttcatggaaaatgagcaacttcatgtgccatgaagagtcaaaggccctttccaagccaactccatcgtgcccaacatgaattatccccgtatgtctgcagagagtttgttgtccaagtatcacaaaagcaaagggcctctcgtccttatgaaactaacttcttaaaaataccccagcatttgccagttcaatagttttggactgacttatgggcattaaaacctttttctcttaagaggaaaaattcccagccaggccgagaaagctcatatcaagtttcagcttgattcatttcaaaaccaccatgaaaactgggacattttctccacaccacaatgggttagtcatggaaattctgccttaatcgcagctaccatggccacagccatgaagcatgcgctctgtgcctctgaaaagtgatgtgacagtattggagaatttctccccttcactgtcagaaagcagaaatgcattacagttcatggtctatggaaaaatgccagggtaacctgaggttcccttttcagcaagcaatctcatatttgatacattttttttctgtatggcagtttggtttggtagctgtttccaaaaagtgctctttccaaactaaaactatggaaagttaaacttagcagaaatgtgcattaagctgggtgtagtggctcacgcctgtaatcccagcactttgggaggccgaggtgggtggatcacctgaggtcaggagttcgagaccagcccggccaacatggtgaaaccccgtctctactaaaaatacaaaaattagccaggtgtggtggcgcgtgcctgtaatccaagctcctcgggaggctgaggcaggagaattgcttgaacccgggaggcagaggttgcagtgagccgcgattgtaccactgcactgcagactgagggacagagcaagactctgtctcaaaaaaatatataatatatatcatattttaatatgatatatattatattttaatatgatatataatatattaatatgatatataatattatattttaatatgatgtatattttaatatgatatataatatattttaatatgatatatattttaatatatataatatattttaatatatataatatattttaatatgatatataatattatattttaatatgatatataatattatattttaatatgatatatattatattttaatatgatatataatatattttaatatgatatataatattatattttaatatgatatataatattatattttaatatatataatgtattttaatatatataatatattttaatatatattatatattatattttaatatatattatatattatattttaatatatattatatattatattttaatatatattatatattatattttaatatatattatatattatatattttaatattatatataatattttatatatataatatataatatatattatatattaacatatattttaatatatataatatatatatatgcattaagaggttaagagtggcttcccctgaggtattcggaccttcctcttactcatgagtgacagaaatagagcagtcttctctgccatatgtcctggagactcttgctaagcgtggccaggcttcactgtgcataggtcttcttagtgcaaacctcaaccagtaaaacagaatgggccattctgccttctctgcatccatagcagagaatgcttcttcagcctcgaagctactcacatcccgctaggagccacttctataagctacattcctggtttttttcttgagatagtttgttcatttgttcgcttgttcctttattgacagaggaaccagcatgttttccctaggaacattctagactttgagaacacaaggatgagttcctgccctcctggggctcacagcctaagtgcgggagacagacatcacacttctgggttgttttaaaagtataactcattacagactgccacctcacacattctgaaatcctaaactgccaggtggacttaattcagtgggcccaggagggtcgggggatggcaaagatggaatcctccctggagtcctggcagaagtttcctggtgttaacttgtccacccctgcacacaagtggacttaccaagtccatcctaagaggggcccaaagctgtcccatcccctcccctggctctctgcattcctctcccaccccactgttatgctgggtcacatctcgggcctcttcctggctccagctgcagtgtgtctgacctgtcaccaatcattcgagcctttggccaccattttcgtcaagtgctccagcacctctgtggccctccaaatcgggccagcactcctcagcccagcatgggaggacccactgttagagagcccaggcaggctctctattcactgggccctggaacacccttcagtcacttggtggcctctccactcctccgcttggccaaatcctcactcccttccctcccctcagcccccagcctcctctagagcagtgcttctcagcttttgccgcatgttcacatcccctggggagattgacatctgcttgtgcccaggatgcaccctagatggggtgagtcagttcctgggatgcagtggtgttttgtttttttaaattgtccaggtgattcctccgtgcagctgagttggagaagcagtgttaattagcctttcgttgttctttagtcacttcatcctgttcagtttttgctcctgagcttgttttagtttcctggacagagccataatataggtttgtccagctctgcccctggtagctaccagccaaggccgttggcagctgtctgtttgctggaaactttaacagccccctcttccatctccttcactggctgccagtcagcatctgctccttgggtttttgtcctctctcctcttcccgagccttcctctgcccctcgttatgcctctgtcctccccaaccagcaccccgcccggcccccaacaaacctccctgtcctgggccttatttccttcttccagaacagttggagatctgcacggataagctgctgaactcattatatgtagagtacatgcaaggatatttgtgcggcgctcttccaaaacagtaaaacataggagggggaaatgatttggaaactagctatccaacaaatgggattgattaattgcagtgcaacaacaattaaaatatttacaaagaattgttagagacatggcatatccggttaagggaaataagcagaatgcagtattacatatagtatgagctatactatctacaggaaaagaagcctggaggagaatgtaccaaaatactaacagtgcttgtcttgatgtggtaagattatagctgactttcttttcgttgttacaatttcgtgttttgttttttaaaaattatacgctgatcatgtattacatttatcatcaggggaaagtgatttaaaaagatgaattgggggggtgttcatgtcagatggtggctttttgcatccatccaagtgtgtaatggggaattttcattttagacaacatggactcagtagaggagagtcccagggtagagtctggaggagaaccttttaagaaaataagtttctccagcctgggcaacatgtcaaaaccccgtttctacaaaaattagccaggtgtggtgttgcgtgcctgtagggaggctgagatggaagaatcacctgagtccaggaggttgaggctacagtgagccaagattgtgccactgccctccagcctgggagacagagcaagaccctgtcaaaaaaaaaaaaaagagggagggagggaaagaaaagaaagaaaataataataataataaggttctcttaaagggaaggcccctgagaggggtcagcttagtgagccaggactggagaagcacattctagcagggggaatctttgccctccccctggccagggtcctcctggcaccctgctgagcccagctagagagatgggtgcctttatgagcctcattcaggtactggatgctgatgggctccctcttggcttcagagcgccactgatgttttcctttgtgccatctctgcggatggttaacctttcgttatacctgccttgccctgataagaggagttatcatcaggtgctaggataatgtcacttaatgtaatcccaggtgtaatttaatggcttctcctgaccagtgacttgtgcttgattttgcatattctactaaagaaaatagtttgcagataacacctgcctgttcattaatagaataaagctgtcatacagccagaccacttattataaccatcagcaaaagaattctccccaaaataaagtgaggggaaatgcacatcattttttttaacttctctgtcctggaccagtatagctgcagttatggcagttaggatgtttttagctgcaaataaagaatatctgattaaaactggctgaaataacaggggtttgttaatttcacatggcaagaagtctgggcactagatcatcccagggttgcagcccatcggggttgtcagttaacattttccatttttctgccttgccatcctgtgactagatggccacatggtcaccagatggctgccacagctccagtcatcctgtccttacacagtagcatcccaagcaggaaagaagaggaacagcaacacaaaaggccttctcacttgcctctctctggacagagagagatatgtgtttcccacaggctgtcagtatactgccctatattgctcagtaactcaaattggactacatagctgcctctagaccagtcacaagtgcagaggagcaggactgccatctcttcttgtcttttggaatcaatgaccggcatccactcgcttgtggctgttgtaccttgtaataactgccttttgtgtcgagactgccagagtgttctgtctactaaaatggacttggatttgtggaaaaaagaggattcttcctctaatcctctttatgtagctttttaaagatttatggatatagctgtagaagggaaaaagaaaaatcctgtttctctctcttccatgcaatagcttgttaaactaagaaggacatgattattctattcagtttgaatcctgtttattgaatgaccaaaggacgtaaacagcctttgtaaaagatgaagtgtaatccagacagaaaggattattattgaggaagagaggtgcttatgacatatcataagagtctttgctcctattttggctcttaaaactgttttacttttgttttagacttagaaggttttgactccgtggtatcatctactgagaaactcagtcatccgaccacaagcagaccaaaagctacagggaggcggcctccgtcccagtccctcacatctgtaagtgtctcctcaaactgtatgttcccttacttctctacagcggaaaagcaggacagattagaaactctagctaaggactcttctgcaagcagccgatttgaggacaccctgggagagggaggccatgagatacactgccaaccaaaagtgatttcagtcttcttgacttgagcggcatttctttctatttgttctttgtgtttctgccagcaaggtaggtgctctgtattcccactttccttttctttccttccagactgattcttattttaacctgaaatgaaatgggtaagaaaaaaaatcacgttttatgggtggggagaggagaatgaggctggtttggtgtgtaaacaaaacaaaactttactaaataaagatctgctcctatatagcgccaggcagcagccgaacctttctctctcaaatccccgttgcctgtacccctccacagaataccacgcagaccttcaggagattgttttcaaacatatgaggcacctggtgatgaaggagagactgattggaacactcaggataacccatagaagatttttgtttgggttgttttgaatgactttttattgcaaacctattacacgtttattgtaccaaatttgaactacaaaatgtataaagaagaaagttatctgtaatcctgctccccagtgcaaagaaccgttaactttttgttatacagccttagctttttaaaaaaaaattatttgtatatataaaattatttcttcaccaataggattacgtagtacgcatcgttgtgaaacttgcttttctcctcttctgttgtgtgcctttctccccagtcatgacacattcttccctgacatcacatttcatggctgcccatttttctaacctatgagtatgtgagcgtttagccaatgtatcgttattgggcatttatgttgtttccagttcctcattataaacaacactcaaatgaatgccactgcagaaaaatcttgatgctgctctaaaattattgacttgggtaaaaattttctggaagtgggtcaaaaggaaatgtatggtttgcttttgccacaggttgttctgtcccctccaagctcaccttccacaagttgtgtttgtgtataagttcgatttctctctctctctctctctctttatttccatatagcacattgccttgttccagtgagtctaagtccttataacctctacccagataaaccaaggaattaaccttttgcaggtttcccaggacacttcctattttcatgtcatcactgatcccacctaaggtgtcatcatttagaagaaaaagaatgtcacttccttggaacctcttctctcatatctagagtctggaagtatggtttgagtcatcctatttttcctcttagtatgaaaaacctaactgcattgacacctttttgggtgaaacacttttaaaagtagctgactttttttattgttatacagacgtctctgtcaacaccaccttctttcccttctccctctcacctcttcacaccccaccccaacacccctcttatacccacgacctgtttagttggctcttagtatctctatattttgtttttcaatcctacctcctctatcttctctgtaaatccttcatcatttttgtcttccttccaaattcttcccaacttttcaaggtctagagagccttgtgacttccagaattacagaaaggtttaaattaccatctcttgtcccacctttggtccatacatcccatgcctgagagttcgtatgtatttgggggatgtggtgaggatatatcatcttcactgccttcagactacacagttgttcattcattcaacaactctttatagacatctatcccctatgggctcggcactgtgccaggtaccaaagatacaactggaatgaaaagcacatggtcactgcctgcaggaagcttacggcacaatgacttgaagtttggcattttatatgaagtgatttcatttgcagacttaaaacaaaaggatatatttgtgctttaaagtataaatattatattctcttcattcccattcatccctacttggatgtgtacattgaattcctatttactcttcttcagttagcacctgtggatttttcataggcaagtggaggcttagtggatatgggcgtattcctcaaaggccactgggggaaatgatggaggaaatgcaccagtcatgattccccagcctggggcctctgaccctagctgaagttctttatgtttataggactcaaagagcaagctttgattggcagctcatgaaccctaggttgtaatggagggaactggctttttgaataaaatctcaaaatgaaaggattcaggcatggtatggtggctaagcgttaagcctagattaataagaaggcttggtggtgggggaaacgttattctaggtaattggattttcagattaaatgaagattaacaaataaaacctgttaaattgaaaaatttgcttaaaaattccctaaaatgcattaggtttctgccttaagtaaacagaagaaaacatacgatatttttgggtataatttttctataatgacgccaagtggtgattttaaatgggactgtttttctaccaccagggtagaaagcatagagatgaagctgaagatgagcttgctcaaagagatctgtggaagattcttcattataaaggattccttgctataggaactcttattttaatttgctttgttctaaaatagggaaattctagcccagtgatcatctatgaccaagtgaattccagtgaattggtccagaattttttttttttttccagacagggtcccactcttttgtccaggctggagtgcagtggtgcaatgtcaatggctcactgcaccctcgacctccggggctcaagtgatccttccacctcagcctcccgagtagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggcaggcatcctgtgtggcatgtcactaagtctgcagtacaagctcactgcagcttttgcacatggtagcaaatgtttagaggaaggagcaggaaaggatggacgatggatgcttgcaaggatgaagtgattgatggacatcagtggcaagatccctggtttaggaaaccttgcttcttagtcgcagttctgccactaatcagctatgtgacttgagcgcgtgcataacagcacacttttttgcctcacagggttatcgtgagaagacaaaatagcagtgtcgagtgcttttaaagcatacagcattatattaacgaaagtggtgtcagctaaggtgtaattctgacaaaagcattttcttttggctttatcagtcatccctttcaagccctgatatcttcgactccccaagtcccgaagaggataaggaggaacacatttcacttgcgcacagaggagtggacgcgtcaaagaaaacttccaagactgttaccatatcccaagtgagtcaccagccatggcgagggtgtccctgtcatttcatgcatgtgctaatgatgggttataaaccaaacaaagatacacaaacagtgcaggtgtttgtcattcttcagtgacagcgattctgttactcatcaaaatccccaaggcatgttgcagtctccgaaactaggcagaatccctgagatacaagttcagttgtttatttcccatgttgttctcttgtggtttgatctcctcttcataccatcacacacacgttcacaaataccttcacacactaccaccatcaccacaaccagaacaatttaaaaagccgtgagacgtctagagagaagacattaaatatattaaatgctgtgccctctgcccacagatcttgtcttttatgttcaaagctggtcacaaattatagttggaagatcataaatataaataactaatgtggtctcttaaagaaaattgatttggagtcacattctatgataaatttatagtctaaaaacactttaattttattccatgcccagagagtagtatagatactttattagtttatgagaaacaaggaagacatttaacttttagctactgcatgtaacttttgaggagcatcttgtacaaattctctccctgtgaatacgaaccaagattttaaaattccattttctcccactaagaaaaccaagtcaattggaattattttctctgaatattagcaacttctttctgtctaaaagcagaaaactatagtcacttgaagcaggaatagcacaaagaaatcaaaggttaccgtggaattttccttctccatagatttaagaatttacatgtatagattttcttaaaaatctgatacagtaagcaaaacgtgatcctatacaacagatcagttgtaattattcacaaaaccaaagcattctttctttataaaaggattccatctgcagaagttggatttagacccgttttttctggtgaccataggtatagtttcatttgacatccctggggtgtctctacagtgacatctactggtggacagtgggttttcgtggttctgatgtacacagttgtatcccattagcctatttctcttccccggagttgtcatgttgtgctcttcagtgcttctagaaattccacttgaactaatttgatcagggagggtggtggcctatactctgtgagggctttaaaattgctcagtagccgaaatgggccgggagagcgtgtcatataggaaatgccaagagaagcattgattcaagaagtgtctggaagtcagtcagtgcaaaggcactggtgggtcacaggagtatgggaggtccgcaaggatgcaggatgggcaacaggaaaaggcataagcccaggaatagatgacaagcaaaggagaggacaggagagtgcgaatcttcagactcaggcagccacagtcacagtgctggacttgagggatccagttgatagggaattgatcccctgttctgccagttattacctatgagtcttggggaactactcagccacttctctaagcctcagttttctgcttggtaaaatgcttgtgccaaccgatcgttgctcaaattgtctagccggtgtccggcatgtgatcattgctccagaaatgtcagttcctcttccctcttactctgactcctactaatgataaagcacaggctggcggagcgctattcctggcagcagagagcacttttcctcaatggtaacttggcagaaaaaaggcgagcagagaggctgggaatgatggcccatctgcttttggctttctctgcccagtctctccctctagcacagcctgaatccagactctgcctcctcgccatgccagccaagccccttttggctcctgcgctggggtagcctgctgggtacctgctgctggagggagcctcacggccgcgttgccaagcttcaccaccagcctctacttctgccctgctgctcatcgcccccgcctcccaacatcctgtcccactcttttccctcctcgccacctgcctcccagctcccttgttggtgccttctcccccaggggcctactgggcacccctcttctctctcgcccatgactgtccttcttcctcggccctcctggcctcctcaggacacttctccatcaggcctcccccgccagtctcctccaccttcagcctggcccttcactggctctttctctcagcgtatcatgcagcttagggtctccccagtcctggaaagtgaacagaacccttccctgatcccacctccccctgaggcttccgcatgagcatgctccctctctcctgtcttcctgcctcaaccaagtttctggaaagagagtcctaaactttcaggccacaccttcacctcccatccaggtggtcatctgccaggagcagctttctgtctccctggctccaccaagtggactccacccagttttcctctcagcacccttcacccacgcatgcaaccacttcgttccttctggactctcctccaggcctgtcttctgcttcatcccctcttcctcccctctttcccagtcactaagggctcctaaaatccaatgtgtcaaaaacggaaatcattatctgattcttcagtctgctgtttctcccatgaaaggtacaatctcgatgcctggtgtgtgcaccacacccgtggtccctgatctgtccttcctcctccaccctctgcatcctgtccaggaccacatctccctgctcacaaggcgtctgttccatgagggcagggtctccatcctcctggcccactcctgcccccagcactgggaacaatgcctggtgctctatgtcggctgtgcttgccttcgccacatcactcaaagttgtcttgtgtctatcctcctagccactgcctgggtccaaccctgaccgcttctagcttacgttgtgtaagactctcccagcagttctctccagctccagatctgccaaccctttagcctttctgcagccagcatggtcctcagcaccgtgtgccctcctctcaccctttcgcctagccgcttgtacttcccagccttagctctgcccccaaggccctctcttgccccctctgacggtctagcagtacttcccaccaatgcattttgctctgcggtctctagacctttgcctggcgtgttccctcccgctgcagcttctttctctaagtgcccctcctttcctctggctacttcttggtcctcctccaagacgggactgtcagcacctgcttgcgatgcctgcccgtctggatggctggccccttttctgtgtttctggggctctgtatgctcacctccctctgtgcagttgtccccccatctcagtgcgttggtctgtctgtctgtctgcgccccactgggttctgagctccctggagaccaggagaatgcctattaaggcatgtcttgttcacttcagagtttgtggtgcctggcaagtagttgggcatctcaatgtgtatattgaaccagtcggaaactctctgtccagaaagaaggtcacatttaaaatacatagaaggcggcgtgtgagtaagggggaaatgcctgtaccaagcaggcccttggtggcttgtggatgaaggaacaagtgaatggagtgtgtggagagaggcggggacagtggtgttaacggagagtttgactaaccaggacaaagacgcagcacacaaatccccggccctgaaccctccctgccttccctcgtcacaggtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaagtgagtgcctggggactcttgggggccgtcacccaggttgctctctgccaggccagcacctagttctgaaagcatggatcccagcctgccttggagggcgggcctggtctccccgttgatggtggcagcaatggtgggagtgcgtgtagaccccgagagtcttaatttatacctaaattatgctgcatgtttttgctggacttactgtgtgcaggaagggcacaggctggccatggggcatagagggatgagtccattgcagggactgatgctctcagcaggctgctaagaagaaaagcatttaaatcccccataaaatacagtatgtacatgaaccacttcttaaataagctcaacagctagcttttcctcttgcaacagaaaaatggcaatttcttcacttagctgccagatgaagcagttggcctgcattgaggtaccagtaatgtatgaagaagatgtagggaatcttgaagcccaagattttacactcagtaagatgttctcaccatgagactgcagtgggcggggcggggcagtgggggtctttcttcctgcatggctgcacacacactctcgccacatctctaatcctcagggagcactttgttgaggagaaagacctggacacaaaaataagtatcatacatcattatcatccaggatgtggtttgcaatgacaaagcccataggaggattagaagtagagaatgggcatggtggctcatgcctgtaatctcagcactttgggaggccaaggcaggtgaatcacctgaggtcaggagtttgagactagcctggccaacatggcgaaaccctgtctctactaaaaatacaaaaaaattagttgggcgtggtggcgtgcacctgtaatcccagccacttgggaggctgaggcaggagaattgcttgaacccaggaggaggaggttgcagtgagccaagattgtgccactgcactccagcatgagtgacagagcgagactccgtctaaaaaaaaaaaaagtagggaggcactgctctgagtaaactgaggctcgaggagtttagggatcagttagctgtttcttgagagaatcaagggaggcatctcaaagagttatttcccgggtaggattttgaacgatgatttaggattgccaagagcacactactccagcagcgaaaacatcatgttgattcctggccacacggggcagcctggtgaggtcaacacatccccaggtgactggcctccttggattggaggtgcctggggtggtgacaggagatgcagccagagacttacagcgatgaagccctctgccagtctggggtcagcagaagccctgtcacctgcctccctctacgtggcttgagggccctaatgtgttttgtggtcacttttgggggataactcggttaagcaaacttaagttcttttctgaagggctcttcagagccttcgctttgcattgggaggatggagaggatagcatatgcaaggtgtcccacacctgcttaatcacagaaccttttttttccagagcatcctaggatgagggttccatggaattcgctttgagtaatgtggctctaagcgggttctgttccactcaggctgggagggaattgaagcctcttggacttaccccagcctggaagagatccatcagattaatatacaggactgacagatggtacttgagaaggaatcctggggccagccaggctacctctaaccccttaaagtccccagctcctatctggctctggaggttactcatttaggtacccaaaggccccatccacgtccaggtgacctgtgtccctttcctagacaggacatcacagaggccccaggataccccagagcattggttcttgccttctgaacaggaccatcatggcatcagactggcttgaattcagggctttagctgtttggaccctatgagaggtgcctgcaacatctgaaatgccctgtgcttccgggctgccacaccatgtttctcccccactgtgaagcctgcaaatagttggtgggaattgtctttccccggccaacatctcttgagtcaacaccccacagtggcctctcttccaaggcctgccttttgctgcctacgtcagtctggccttcgtgcccagggtcagtgggtccctactagtctcttgtattagtccttcatgtcagtttcctgttagccttcaactcaagtccacaccagctctccttatccccaaataagctggttctcacctccctgcttttctctggcttttctctgtcaattcccctgtgtttcttcctcctcatagacttacgctcattttcatttcactagttcaagacttagtgactttctttggactgctttccccaattaactccccacagctggactgcttgaggctttgcctgccagtctcctggggttggagcatttgcttggagtctcaccttcttccttcctaatccctaagtagtacccactgagatatgggtgcatgatgtgcgcttaaataaatacagtaatgaatcacaactggttcatattcgttgtgatataaacccagtatgttgacagcagagctgggacactgccccagagaatagggaccatcatcgtgctcatccgaagtgagaaaatgcaatataacttccaccttattttactgtggtgtctcaggcatctttgtttcttgattttccaatccagtctgtaaaaatatgcatgtaaaatggagtgttggatacctgaaaatggaggacagctctctgcccagtgtttggatgcttgcagtgtcctaagtatagagccctaactttgtgggatggttagtgctgtgcacttcattatttttaatgttggaaagggcattaggccgtggatcctaagtcatgccagtttctctaagacatgattgccataccattactccaattattttacccccaagtttttgggacttactgtgtaggattttatgagaatccatgaaaacgtaccagtaacctttcagcaattaaaaaccctattgaaaataaaggaaataggccaggtgcggtggcttacgcctgtaatcctagcactttgggaggctgaggtgggctgatcacctgaggtgaggggttcgggaccagcctggccaacatggtgaaaccccgtctctactaaaaatacaaaaattagccaggcatggtggtgtgtgcctgtaatcccagctcctcgggaggctgaggcaggagaatcgcttgaacccaggaggcggaggttgcagtgaaccgagatcaccccactgaactccagcctgggcaacagagtgggactccatctcaaaaaataataataataaaaataaataaataaataaataaaataaaggaaatatatatggagtggtaaaaacatctgcaataaaaattacaagaagagccaggcttagtggttcatgtctgtaatcctagcactttgggaggccaaggcaggaggattgctagagcccaggagttcaagaccagcctgggcaacatagtgagacccccatctctacaaaaataattttaaaaattggcctggcatggtggtgtgcgcttgtagtcctagctactcaggaggctgaggcaggaggatcgcttgagtttgggaggttgaggctgcagtgacccatgatcgtgccactgcacttcagcctgaacaatagagcaagcccttgtctcaaaaagaaaattgtaataagtacatttaaagcccagtgattttgtaataaaggaatggttatggggaagatgacagaatatgaacctgtcatattctgacaggttacgtgaagtctagtaattgggcaagtcaggccaccacgctgggcctctgtttccccatcttatccttttgagagaagtttggactaagggatttcagaggtcacttccgcacccaccagttgctggctacatattttaggggccccagaataatggtgagccttactgtctgaaacaaattttaagcagtaacaatgcaaagaaaataatgatgtgttgtccacagtttctttgtaaaaaaggatcagatggattttgtagtcataataagagatttctgatctctgatgaaggaagtctgggattttggttaatttcattgccatttgcttttcagacgagagattaaacagttattgtctgagttggatgaagagaagaaaatccggcttcggttgcaggtgcgtccctttgggttctgctgcccgtgagtcctaggctcagtggggcaggacattgtgagggcttttatttcaaaaataaatgattgtcacctctctgcagatctggatacatttcctgtgaccatcttcttagaatcgtatgggcttactacatatcgtttccccaggaagtcttggggaagggaaacattaggaaatgtgccccaaattgggtttctcatttggaatttatctttttttttttttttttctttttgagacggagtctcgctctgtgacccaggctggagtgcactggcgccatcttggctcactgcaacctccgcctcccgggttcaagcgattctcctgcctcagactcccgattagctgggactacaggcatgtgccaccacacctggctaattttttgtatttttagtagagacggggtttcactgtgttagccaggatggtctcgatctcctgacctcaggtgatcctcctgcctcagcctcccaaagtgctgggattacaggtgtgagccacggcacccagcctggaatttatcttaaacatctctgcgaaaagcccctctcccacctccatttccaagaggcctcattatatgtggtcactatggctccaggggccacagctgtccatgttcgggggcatttgctcttgatttctcagtgatggccatttctgtcctgccagggcgttagagctctgtcccctgtagcctctgattcaacactgctgttaccaaatggcagagaatgcgtgggagttctgattgaccgaaggtagactttcagctttcatccagttggcgcccttgtggtgatggggacccatgctgcttaacaaaggataggtagctgcttgccatcattttgggggtgctgacagacacccccttgagccaaccacagctgccttccaacactgccagatggccccgcctgttaggaccgcctgctctaccctctggctaagaaactggaattattgctgcttttgacaaactttgcagcctggcagcctgagaatcaaaatgtgcaccatttcctagtgcctcgtgtctgtgtgcctgttctgtgttgatgtcacttctggcattgctgttgattgtctattcagatgtcatgtcacctttaaaattgtcagattgattgttttctttcagtcgaccgggttgataatctttcagcttctataaaaccagccgattcattatgactttgttccattcttatttttctctttctagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaagggagggaaagttgtattatttcctgcactgggttacccgtgtgtgttatcgtttaaactgtattcacataatgtcatttgccttgctcacttgtaaccccttcctcaggtccaagagaatgggaggagggtcatgttgaagtgtagccactggaactttcttgcatttatggagttgctttttctttcccaaggaaactgatgtttgcctgtccgctttatctttgtagtacatgaacagttcagccttagactatgtaactgttttctcatccttagctgaaaatgaggggcctactgtattgcgagactgttcaggggtaggggtggagggggtggtcccttaatggcccctgaagatgttggatgtgtttctcaaaagctgctttgtctctttcctgagtttaatagtgaaactactaaacattaatagatttgcacagccacaaagaatgagagttgataataccgaagaagtgatgcaaaaacaaaaaatcacattactgatcattgatagtattacaaataaatgtctcttcctttctcttcctcccttcctccccctgccttcctcttaacctatgtgctcatccttgctacttgaggctgttatttccctccgagtatttaaggagcccaaacaccttggtcttcctgggtgggggcataattaagggaagggagtgtataaggaaggaaacctcataccctccattcccatccctggatatattgccttttcagcagcctcgggttcagtgtgcttggggtcaggagtgccaggttcccaagagcagcgtaaaacatccctgtaccccttgacagttataagcatttctgcgttaaacttgaagattccagagattccccacgacctaatgatctaagaatgcagattggattctttgatgttcaaatttctcatttacttatgaaaatccctaattatatagttttatataatgtgtatacagagtaggattgttgatgaaattgagcggttggaacaccctcatggaacactggcaacatggaatgtagagagctgatgtcttccccctcatagaggccattggcttcctttgtataaggagagggagaagtgattctggaaggagaagttggtatgtctagcttcattgcggcccctcgggctacccagcaagaggattctgcatcaaggaactggacgagccgctacccaaactgccaccatctttactctttacaaaatggacccatcgagaatgttgaaaagcttggaagtatcacttttgaaaaaaaaaaaaattattttgcattcagcatggactcgaccaggcatctatggagattatttttttgcttcattttataaagttgtatttagaaaagtcttaagtattgtgctttgtaaagaagatgattaaaatgaaattttgtgagaatagttttgttcaaagttgtcatggtccaagaggaatgatttttttttttttttggaataccatttttctccactttatacaatttgatttctcttatagaaatatctttagaagacatggaatatagtgcctctcccccatctttcccaagtgaacagaaataatctgtgaaatctgtgcctgtgaattctgttttttaaattgttcagttttatactcatatctaatcagaaaatgccagttaggtataaattcttttttagtgtaaaaaattttaagtcatcattattcaaataactgtgtaaagccactttttttttttttttttttggagacagagtctcactctgtcacccaggctggagtgtgatgatgtgatctctgctcactgcaacctccgcctcccgggctcaagtgattctcctgcctcagcctccccagtagctgggattacaggtgcccgccaccgcgcctaactaatttttgtatttttaggagagacaaggtttcgccatgttggccaggctggtctcgaactcctgacctcaggtgatctgcccacctcggcctcccaaagtgctgggattacaggcatgagccaccgcacctggccaagccacttttattcacacacagtcctctaggtggcacactcaagtacatgatttgttttcttccataaggacatcctgtatgtatcctcacacgtgtctttgcttattagtggcagggttttctttcctttcataacccgctccttgatgggaaaactgcaggatgtataatttattgctcaaatttgccactgtctgtataaaaataatccccaggtcccacaaaggcctttgtattgtaacgcgaggtcatcctggtctcctttttgtggtatgagattaggttttagtcctctagttattttagcacaaattaacatcgagatgttttggcaccaagggggcttggtgaaagcttccctctttgattttgtacaaacaagaaccgtaacaaagcacgcatgcgtgggtgaccggcattcagcgtgactgattgtggcatccgacagagggaagccttggcacttaggacctaagcccagggaagaagatgctgtgcccaaaattagcacgagtgaaggagcacaatggccaagccagaaataaatatcagtggtgtaaggacaggcagggaccaggtctcttaaggggatgaacttttcctgtcactcctagtcctattcctagggtcaccaaggcttggttcccaacatgtggagcagaggcagcctgtgcaactgacaagaatccatgaagtcagtacaggttcccacatggtggttttactttatgccctttttcttttttgaagtggagtctcactctgtcacccaggctggagtacagtggtgcaatcttggctcactgcaatctccacctcccgggttcaagtgattctcccacctcagcctcctgagtagctgggactacaggcgcccaccaccatgcccagctaatttttgtatttttagtagagatggggtttcaccatgttggccaggctggtctcgaactcctgacctcaggtaatccgcccgcctcgacctcccaaagtgctgggattacaggcgtgagccaccgcacccggcctatttcatgtcttttgaattgatcccaaattgaagtggctgtgggggcagccccttcccacaaatgacggggtgctcattgtgtttgtgaatttggaattcacaataaaatgggctcttccttttttcttgtt

SEQ ID NO: 929 - DNA, 551 bp, mus musculus
ggtcccatctcacacacccgcatggcctgggctgcgagtcgcggagcatcccggagggttgcggtggggcgccacgccgaggctagcctcccctggcgcccgctcaggctcaggctcggccctgggcagcccgcccgtgcatcgttcccctggtgcagaaatcctaccgcccgtgcgccctgggcgcgccgccgggccccgcgccggctccccgggaatgcggccgtcaggtgaggtaggcatgcgtgccggctccgcagcgaagcagcagctggctggggcgctgggctcggaatctgcctcttctccctctccccgcaaaagagaggcctctcggggactttccagcgcattgttgcgttaggactgcattcccccttccttttccttttatcttagtttctccttcagatgcaaaaagagagatcgcaggagtccatgcccagctccagcctaactcggtccacaggcagagaattatgaatggatgctgccttctgatgaggaagtcgactggggaggtctctgcgcacggcgcgctccatcaaagc

SEQ ID NO: 930 - DNA, 551 bp, mus musculus; identical to SEQ ID NO: 929

SEQ ID NO: 931 - DNA, 551 bp, mus musculus; identical to SEQ ID NO: 929

SEQ ID NO: 932 - DNA, 551 bp, mus musculus; identical to SEQ ID NO: 929

SEQ ID NO: 933 - DNA, 16683 bp, mus musculus
cttgcgcggccgcggcggagtcgtcatagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcagtgagtctaccctggctctgggaccgggaaggggggggcgcattcctcctctgggacggccctggggcgcgggcccgactggctgggggatgagggggccgaggtgggaggcaggggaggaagatgtgtctgtcggtcagtcctctccgggtcgggagagattggtgaggatctggacgaggccagagcttcatctagcagtcaggtcctgtccctgaagttcctggtgacaagtctacaaagtttgcagacattggaatcaggtatgcagtcaagcagtgtgacccgacgtcttcaggtttgacaaggaatcttttttgttcaactcgaaaaccttcatttacaccccccagatcggggatagttggcgagcttgaattggttgaaaaaataattttttgcccctaggtcagaacgtgttgtctgaagtaaactgacagttactgaatgtcaatgtctgccccggtcaaatgctttttaggtacagagacctttttccttaaggagggagagaaaatgccaactgtctgctatacgcaagttgcagtactagatgttttatgaaagatatcccatttcatctgttaaacacccccagtgagttgggggaacaagcccagagttattgggccaaagttatactgatagtgagtggtagaagtggaatttgagcttcgatctttctcattttaaagcccgtgctctttccaagtttacagtctacaggggttgggggacaggtgataatagacgtggagtaaacacatgctgtagtaattctcatttctggagagaccatggtgggcttcagtgatcacagaaagcatctttgaggccggatatggtggctcaggcctgtaatcccagcactttgagaggctgaggtgggcggatcatgaggtcagcagttcgagaccagcctggccaacacgatgtaaccccgtctctactaaaaatacaaaaaatagccgggcgtggtggcgggcacctgtaatcccagctactcaggaggctgaggcaggagaatcgcttgaactggggaggtggaagttgcagtgagctgagatcgcaccactgcactccagcctgggtgacagagcaagactccatctcaaaaaaacaaaacaaaacaaaacaaaaaagcatctttgaggaggtgagccctaaagcagcccagcactacaagtgagagaactgcaacaaaggtagatactaagttcagcaacatttgaagaatctactaaaagatgggggtggggggatgggggtggagacagggatgtgggaggagagcagcctgagagtagataaacacatatttgagtaagaaagggccgaacagtttttctggagacagggtctcactctgtcgcccaggctggagtgcagtggcacgatgttggctcactgcaacctccacctccagggttcaagtgatcttcctaccttatcctctccagtagcttggattacaggcatgccctaccacgcccagctaatttttgtatttttagtagagatggggtttcgcgatgttgggcaggctgggccctaacgtttaaaagtttactgtgggatgaaaggacagggaaaacagacataatctcaaaccatgacagtgtataatctcagcccaaggcccccagatagaatagtcttgctctgtcgcccaggctggagtgcaatggcacgatctcggctcattgcaacctccacctcctgggttcaagcaattctcctgcctcagcctcctgagtagctgggactacaggcacacgctgccacacctggctaattttttttttttttgtatttttaatggagacagtgtttcaccatgttggtcaggctggtctcaaactcctgatctcaagtgattcacccaccttggcctcaaagtggtgggattacaggcgtgagccaccgtgcctggcccctctgaatattttctaataactgcatttttcatatggatgtgtactttggagctaatgctgccatctttctgctcaccagattctcttttgatatttacggaagctgaggttagatggaagtacccacaaacacacacacattgtgaatttaaagcttcagaataaatgagaattctttcttttctgaaatttatgtgattttagaaagtcgtaaaggttctagttcatatacaaactgtgagagacaagagagatgatcagatattttttatttctacatattgatcctaagaagtatattgtctttaagaagacccatttatgttttgaaaactggaattaaacatctgtgagcctgactcccagagtagattcatttcttaagtcttttgaaatctacataaaatatcagccgggtgcggtggctcacgcctataatcccagcagctttgggaggccaaggcaggcagatcacgaggtcaggagatcgagaccagcctgaccaacgtggtgaaaccctgtccctactaaaaatacaaaaattagctgggcgtggtggtgcgcgcctataatcccagctactcaagaggctgaggcgggagaatcgcttgaacccgggaggcggaggttgcagtgagccgagatcgcgccactgcactccagtgtaggtgacaaagtgagactgcatctcacaaaaaaaaaaaaaaaaatctcctgggagccccatttgttctgcatatatttgttgagtgcctaccttcaagactggacactaaatacttcctggttcctggtgacctatttatacattcaggcaactcaccagttagtggtggacacccaggcctgcattccactccctcactcaaaaccaaacctcctggtctcctgattcttggccctccctcctgataaatttacaacctccgattgtcactgtctccaaaggaaggaacaatttataggagaactcacttaagagctcctccctacctccctcaaggccccatgccgttaagttggttagttggtttttgttaaagtcaaccaaattaaagctttgcctctactctttctgaaaaaaataaataaataaaaagaaaatctgtacttctgagaatgttaaatatctgaatcagtcacacagtttacatcagtgggaggatggccaaagatgagctttgtgatctttagctttttctaaaccgcccctaaaactattccatgcctaggaatggggaaagggccacctcctcctcctttgaaaagtgctattagtattgcagtggacctgtgttagactgtcctccttttcttctgtagggaaagtatatttcaagttccagctgcctaacttgcaaactaagaggactcctaaagttagagtgtacagaggtgactatgtacctgctttgatgtgggagtaaaatatctaattgagttctgataacacacccaggtttacaatgcacagtcaatagcttggatcctagggcttatgaacaatactttttaaaattggggatctcgatttgaagaagaaacttagggacattgcagaaaatctgaaaggtcttttgcagaaaagaagtcgtagatgttccttatgaggatagacctgaggctgtggggtagaaatgactagagaagtgagaagaattttctgattagagttgagtaacagtaattactggctgcccttctaagtcctgtgctccctacccctggaagtggggctacctggataggaaggtccattcccacactaagatgctgaaattctaaaattgtatgaaatatagtatctttgaaaaattaaccaactactttataagaatattaatttcctaagactttgccactgtatgcttattctcttcctattcttgcggcaggccttaaactctaccttgctctgtgtttactttaacaaatttatgttttttctgacctttgaagctcttcctactttactttattcttaccattcctttcagttcttcaagcccttgtcaacttgctcaactgacctgaggcagcgtgggattggagcatgagcttgggatttagaggcagatagcctgtgtttgagttccctacactacttactgtctttattgttatatcatttgcaaattacagaaagtccagtgatcagaggcttaatgaaagaaactttatttttgtgtcagggagtccccaagaaccatccccaggtttgatgattggctaggaagacttatgggactcagcatatagttgtattcatggccgtgatgtattgcaatgaaagagtacaagaataaaatcaggaaaggaaaaaggcacatggggtggaagtccaggggtaagcaggcacagtagagtcacacaggacgtgcttaattcctctagcaaggagttgtgacaacacgtgtgagatgctgtcttccagggaagctcattagagactcagtgcccaggacttttactggggactggtcgtataggtatcctctgcctaccacatatccaaattccagaccccacaaggaaagcgggagttcagcataaaccacaatgaggcattcttagcagtttaagaaatggtgggagccctcccgaaatctaagttcccggacacccagccagtggccaaccttgaaagcaagcctttccaaggacagcagtctcaggcctgccatgttaatgcttttctgcagagtctccaagaaatgtggggatgggagggaggtcccagggtcagttccatggctcaacgatatgatcagggaaccaatctcttccacgcttcctctccttcatccatagtgagttggtttccatcctcaggctgatcacttcaggctcacaagacagcaactgcagtagaaagggaggacgaggactctccccatagctccctttttattaagaaagaaaatgtttctggatgccgacttgcaggtgtccccttaaatttcttggggtggagctgtcacatggcttttctaagcttcacgggactctcagcaagtatgtggcagagatcctgacagaggtagtgccattaccttctttggtgtggacttgtcaagattcattctctggggctggccacatgggcacgcatcaaaattggggtggttttaacaaggcagaagagatgggctactggctgggcagccagcaagatctgcccctatcacataggacaaatcatttttcctctgtgagcctcagcttccctttttttgaactgggcagattattccttctccttgtcccaggaaggttatgagaataaaacatggcataattaaaatgaaggtaaaataactactttaaatgttagctgtcggcccccaccttccagcaggtcgctaagtcgtattcagatacatttgaatttgacttccttttctttggcgctacttcgtttcagaccctcactttatggactgaagtggacattgtactcctgttacttcctgttaactcctatcttagtttcagttttttcctagacagttcataaaaactgtctttggccaggtgcggtggcttacagttgtcatcccaaaactttgggaggccaaggcgggtgggttgcttgagcccaggagtttgagaccagcctggacaacatagtgagactccatctctataaaaaataaaaatcaaaataaaaactgtcttcaacgtggtgtcagctgatctctttgcaaaattaataaatcacttcttgtctttatggacttcttccctgaaaatctcttgtcatgctctccatctcactcccaggccactctaataactctctggagacagttctccctccatgctgccacatctgcttaatgaataatcttgttcctctttttgtctttgattctctatttatttgttttgctttagagatggacgttcctggagggcaagaacttgtgctttctcagatattcagtgtgttcagtaaactccatccatggagtcattaaaatctaaggaatgcaatgattatgctaaaataccagtttttaaatgacagttctcccttggaataaaaatcattgtttgaattcaaaatatgtttctgaggaagggataaaaggaatttatttccaaaagaaccctcttcttttggaactttagatttgtttctctgactgcaaagcatggttttgttcctggaccaaactgagggtcaggctgctatttctcgtggcccaataacaagatgcaggtcaactgggaaggaagagagtttttatttctgtaagtggctccagggagaaggcctggaaattatcaccagaccaacgcaaaattagaaagttttccagagcttatataccttctaagctatacgtctacgtgttaagtgtgcactcatctaaagacataagtgattaacttcttttaatctataactaaggtctgagtcctgaagaccttcctctggagcctcagtaaatttacttaatctaactgggtccaggtgctgaggtgattacccttatcttgtctcctgctaaatcatggaggtttggggagttccttcagacccccaatcaacttgtttgtggaggcctggggagtctcttcagaccccccagtaaaacttacttaatcgtgctttaaggttcaggaaagtcctaggcaaaactcttgggcttttgttacatcccagcctttgtataaggtcactggcttttaatatttaacttaaccactcagtcagtactgaaacagttgtgatggaagcctatgttagtgagtcctggcctgccgcaatccccactgtcaatttgcgcatgatttctatcatgcttgtatatttatttatcatgagaatcgtagggagatggggcatcataatctttctggctactttttgcttagaggggctcatcattatggggcactgaatgcagcactgaagtagaagaggtcaacttgttcccggtagcactctctgtttcagaggcttagaggcagcacctgctgaaacataatagtatgtaacagcaacacatataaataggttactgctgttttcttctgaagtttaagttgtctagtcttcagttcacagggctttaagaaagcacagcttaggtttcagtgatttccaaataggaaaaatggggaaaaaggaaaaggaaaaggaaaaattgaaaacattattttgaagacctgtggccagaaaaattagaatttaatccaaactgtggaaaaaaataaaaactgaaaaacatcaggcatagaatttaacaacaggtatactatagtttttgaaacaaaatttttctctctctagtttcctatttttattagaagacaaatcatggtaggaccaatttgctttattgtacttggccagattatttgtataaagtgcagcaagaaaaatcattttcttttaaaataaaatttttttatttaatatatattttaaaaattaaaaaaaaaaaaacaggctttgatggaactttgttccatagaaggaatctgagataagactttttttttttttttttttgagacagagttttgctcttgttgcccaggctggagtgcaatggcatgatctcggctcactgcaacctccgcctcccgggttcaagtgattcttctgcctcagcctcccaagtagctgggattacaggcatgcgccaccatgtgcagctaatttcgtatttttagtagagagggggtttctccatgttggtcaggctggtctcaaactcctgacctcaggtgatccacccacctcggcctcccgaagtgctgggattacagaagtgagccaccttacctggtaagataagacctttttaaagccaagcccagccatggatttgtaccatgaaatacctatgacttgggtgaattcctctcctcttgaggtcccaagataacttggggttcctggcctgtcagaaggtgacattctttacttaccacagatcagaaaccctgtacagggactgtacacaaaatatgagggcagttttccaagggttttcttggctccctaagtcaagtttgattcattaaaggaaaacacaccattccagttaaagccttggtaaaataacaagtttttccagttgtgtcctgttataaatgaaaacagattcttattgaacttatgcaaataactatattgccataattaagaatactcacaaatagtttccaaattctggagaaaattgggtagaaacaaatatgctccacattttgttcatgggagtatactaaattgttaaaagctgtcagtagctcagaagaaaagtttccttgactctgaaaagtaaaacaaaggattagcaatattttaagcaaaaactcaaaaagatcactccagtctcctattcagttcatgcagttaattactgtcctgcttgatattaatgaacatgttagctcttcaggagtcctgaacatttttcctctgttctgatgtcacaatctccaaagttatcagaaacctgcattcaagagcacttgttagagctttatagctgattataaaatcaacttctaaagaggaccaaaacagccgggcacagtggctcatgcctgtaatcccagcactttgggaggccaaggcaggtggatcacctgaggccaggagttcaagaccagcctggccaacatggtgaaacgccatctctacaaaaatacaaacaaaattaggcatgatggcgggtacctgtaatcccagctacttgggaggctgaggcaggagaatcacttgaacccgggaggcggagtttgcagtgagccaagatcatgccgttgcaccccagcctgggcaacagagtgagactccacctcaaaaaaaaaactaaataaagaggaccaaaacaagacaacaattgttcatggatgacaaaaggttttcgggtagccataaagacacagttgaggctgggcatggtggctcacgcctgtaatcctagcactttgggaggctgaggtgtgtggattgcctgagctcaggagtttgtgaccactccaggcaacacagtgaaagcccgtctctactaaaaatacaaaaatttagccaggcatggtggtgcacacctgtaatcccagctactcaggaggctgaggcaggagaattgcttcaacccgggaggcagaggttgcagtgagccgagatcacaccactgtgctttagcctgggcaacagagcgagcagctatctcgaaaaaaaaaaaagaaaaaaaaaaagacacaattgacaaaatctgttacctctgtggcacacaataatttaacataattataattattactgataacgtacactgatatatcagaattataggagtttcacatgattttggaacacataccaataacatatttacacatatatggcccaaagaaagtcaaaccccattttatatttggcaatgcttcctgtgtggtttttggtactaaataagccaaatttcacctttacgttagtgtactattaatgttaaaccaaattcttattaaaacctcatagacatattgacacaattttaatgtttgaccataaggtaagatttttatagatcttttataaccctttataattttcgttgaagagcaggttagtgctttcaaagaaacctgttatgcttttattttattgattttatcgatttttttttttttttttagagacagagtctcactttgtcacccaggctggagtgcagtgatgtgatctcggctcactgcaacctctgcctcctaggttcaagcaattctcctgtctcagcctcccaagtagctgggactacagacgtgccaccatgcccagctaatttttgtgtttttagtagagacggggtttcacaatgttggccaggctggtcttgaactcctgaccttgtgatctgcccaccttggcctcccaaagtgcagggattacaggcatgagccactgcgcccagcctatgtgcttttattttaatactcaatttacagaaaaactggatgatactcttttaactttagccagtatgtttacacacagaatttcctttacaatcaatcttccacaacttgcttaaaccttcatctttattttatccaacttaaaacaatcctttaaccttttaatctaggcaaaaatccacattttcatgcctccttataatctttttaccaaaagcatattttactttccttgtaaatatgctttttaccaaaagcatattttacttttccatgtaaaactttcttcaggccgggcacagtggctcacacctgtaatcccagaactttgagaggccaaggtgggtggatcatgaggtcaggagttcgagaccagcctgaccaacatggtaaaaccccgtctctactaaaaatacaaaaattaactgggcgtggtggcaggtgcctataatcccagctactcgggaggctgaggcaggagaatcgcttgaaaccagaaggtggaggttgcagtgagccaagatcgcaccattgcgctccagcctgggcgaaagagcgaaactctgtctcagaaaaagaaaaaacaaacaaacaaaaatctgtttcttcagtagtgttaaatacatgttacactgttaactcttagcaacctttacttttggtgaaaaccttggtaagtttgggattttatgtactaggtgtggagcctaagatgtagacagaagtgcagataaggtctgacttattccagcatctaactccatgtgtcccaggccttatctagctgtaaagcaggcaagttgtacagctgagagtcatagtggcattttataaagcatttaagagacctaatcacctttaaattgtacaatatttgttgcataaattccgtttcataaattctttcacaacttacacagacaagctatgacataccttgactttctgacttgtcctaagcatccctctttttaaacatccagttactttactttaggacaagaatttgccatacaaggtcctttcttatataaaatctcttttctctaataccttttgcatagctagggggcttggctaatttcacatgtctccaggccttttctagaatctaatgctacaaaataaatcaaacaatgtttaagtcaaagaagcagtttatgatgcaaagcatttagcaaacctaatatttgacctgcataatttagaccaaatgcttacattttgaagatattttattttaccagtaatctttaaaactgtctttatttttataactttctttatatctctcttatttcctggtttcttttaccatgttttatatataacctttaaataagctttgagttagacaaaaattagttaccctttaaaaaggacacaatgtttagaaagaatattttcctacaatatatttttattggaaaatacccaaataatgaaatatctgttatttaatataactttagattcaaaattatgacatttgttatgagtatcccattacatttatctaattatttattttaatcatttacctagattatttatgaaaactgcagtagtcatcattgaaagttatgagaccaccattgcaaaattatagctgagacagtgaaagtgatctgccgtaactgactccatcttgcttctaacctccaagctattcttgttcattaacttagtttatagtttagctttgaaacaaagatgataaccgtcctttcccagaacaaacttcctttatgtctgtggactagactgcctaaggccacaagatcagaggttagggtattttactaaataattcaagatgtagctatcttcattaaaccaatatcagtgttttatttattaaaaattacacaagcagccgggcacagtggctcacacctgtaatcccagcactttgggaggctgaggtgggcggaacatctgaggtcaggagttctagactagcctggccaacatggtgaaaccatgtctccactaaaaatataaaaattagctgggcatggtggcagacacctgtaatcccagccactccagaggctgaggcaggaaaatcacttgaactcaggaggcggaggttgcagtgagccaagattgtgccattgcactccagcctgggcaacaagagcaaaactctgtctcaaaaaaaaaaaaattacacagcaaagttcactctgttttgggctgagttatcgttttgtagcctctatgccaaattttgataccttatagtatttggcagagataagtatgaaattgcttgatcaataaatgtaaacaaaaatatatgctggcaactccgaagacatttctaatattactttaccagtaatttttaaagctagcttatttattaaagattttacttaagtcacataaacttgaaaaagcatttgactagtctttctttttttctgttaaagtatttaagcacttctatttttctgtgagccaactaattagaactctttcgtatattttcagtagtgaaatagtttggtcatgctttaaggttcaggaaaggcctaggcaaaaaactcttgagcttttgttacattccagcctttgcataaggtcactggctttttttttttttttttttgagacggagtctcgctctgtcacccaggcgcccagctaatgttttgtatttttagtagagacggggtttcaccatgttagccaggatggtctcgatctcctgacctcgtgatctgcccgcctcggcctcccaaagtgctgggattacaggcgtgagccaccgcgcccagcccggtcactggcttttaatatttaacttaaccactcagtcagtactgaaacagttgtgatgaaggcctatattagtgagacctggcctgcaacagttttataaactagtgtggctgtctacccattttatcataccactctgtacaagtagagtagtcataactaaagagaaatgagtgatttcactcaatcttagcatttgttctgtcactccccattcatccattcaacaagtacgtactggtcactggtcatccgctggggatacagtggggtatcagacagcccaggtccctgcactcatggggctcagcatgggctttcagtctggctgagaagacattcaccaagtaatcggtagagtgttttgaagattgttgatcaggcaacagtcttcaaaacacaggatgtgcggagggaacacatctcaggacatccatcgtagtcaagggaatatttcctaaggagaagggatatttaagtggagacccacagcatatggagagttagccagataaagagagagcagacaaaaatgtttcaaaccaaggaggcctccttggaggtagtgaagaatttccatgtgatcatatgactgtagactgggaagaaggagaaagatgagaactagaccagagataagtagcaagtagcttcctgtggtatgtcctaggggtgttttgttggggttgacagataaacactaccagacacaatgggaggaagtagatttttaaatgggaagctggtgaaaggatcattcagatggagtgataatattactggctcccagacacctatacagtctgctggtttcctggaagtaataccacccacagaatgaggatggaatctgttgtgcagagctctctttgccattcttatgggaccttctccacctgcctgccccttcaacaggtgtaagtaagagaggcaagaccgccctaatgtgccagctatttctcatgagaggaggatgtcaattgcctgggagcatcccccagcaggtccagcttcaagacctgcctcaagtctctttcagcagcctggattctgtaggatgtggactttgaaatgatatttgtctacaaattagccctttttttttttttttagacggagtctcgctctgttgcccaggctagagtgtagtggcgcaatctcggctcactgcagtctctgcctcccgggttcaagcaattctgctgcctcagcctcctgagtagctgggattacaggcgcacgccaccatgcccagctaagttttttgtatttttagtagagacggggtttcaccatgttggtcagactggtctcgaactcctgatctgcccgcctcggcctcccaaagtgctgggattacaacaaatgagcccttatagtgcaatagaaccttgacacatgtcttttcacatcttccagaaagctaattctgtggttttgttttgtaaaaactggaagttttatgggttccacttttaatcttgttctacttatttgctcattattattaagaatgatttctagtccaggcttggtggctcacgcctgtaatcccagcactttgggaggccgaagtgggtggatcacctgaggtcaggagtttgagaccagcctggccaacatggtgaaatcccatctctactaaaaatataaaaattagccgggtgtggtggcgggcgcctgtaatcccagctacttgcagggctgaggcatgagaatcacttaaacctgggaggtggaggttgcagtgaactgagatctgagatcacgccactgcactccagcctgggtgacagagtgagacttcatctcaaaaaaaaaaaaaaaaagatttctgtttctactagggcttgccaagatttctatttcttatttaaaattcccccagatttatcatgggacatgttaatttgagaaaggaggggcattttttctttgaacaggagggaaggaggagaaaataaagatggcatacatgagatctagaaaggaagaaaagtataaaggagccttgttcttcctggcaaagtaggagggtagattatttactgagataaattagaaccagagacttgagcaagaaaattttgaagcagctactgggaagagtatactaagggtctttgaaagagatgaatgaggccaggcccggtggctcacgcctgtaatcccagcactttgggaggctgaggcaggcagatcattcgaggccagaagttcgagaccaatctgaccaacatggtgaaactctgtctctactaaaaataccaaaaaaattagccgggcatggtggcaggcgtctgtagtcccaggtactcgagaggctgaggcagaagaatcgcttgatcataggaggcagagcttgcagtgagctgagatcacgccactgcactccagcctgggtgacagggcgagactgtctcaaaaaaaaaaaaaaaaaaaaaaaaaacaaaaaaagagatgaatgaaaggcccagtatgattggccagtccaccaagaaagtggtgcttttcatcactgtcagtgcttctcattacttgtttcaggtccttatgaacaaggaacatgccctaatgctttagattctcataagatctctttaagggaaaaatctcaaacataataaccacagattctttttattctttacagactatttatttaactttgcatctgctgccacaaaaaagataactgaatcagttgctgaaacagcacaaacaataaagaaatccgtagaagaaggaaaaatagatggcatcattgacaaggtatattcaattatcttttggaagtagaaatgtatgaaattcattgtttcctcttgatggtttcttcttcttatgaacattttttaacctaagtagaatatcatattctgataaaaatgttaattgttgagatttttggttttttcctctctttgaataacaagtaagtatcattaaattacagtacttgatttaaatagctgtttttattttaatatattacaatcaatacattgatacttgggggttatactaaacttttcatgttggttgtttgtttgtttgtttgtttgttttgagatggagtctcattctgtcacccaggctggagtgtggtggtgtgatctcagcttactgcaacctctgcctcctgggtttatgcaactctcctgcctcaacctcccaagtagctgggattacaggcatgcgctaccacacccagctaatttttgtatttttagtatagacggggtttcaccatgttggccaagctggtctcgaactcctggcctcaagtgatccacccgccttgccctcccaaagtgctgggattacaggcatgagccaccacgcctggccaacttttcatgttgtgagtttaactttataactgtttgaggatatatttatgcctttgcatcatgcgactaaggtcctagcccattaggaacaacccttttaagactctaaggagtgagtttgttttttgcagtgggcctatggcatttcatttatgttggtagatatttgaactaaggaagtcatcaattaaaccttagatacattgctatttaatttgactatgtattttttttaacagacaattataggagattttcagaaggaacagaaaaaatttgttgaagagcaacatacaaagaagtcaggtatggtat

SEQ ID NO: 934 - DNA, 304 bp, mus musculus
cgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggc

SEQ ID NO: 935 - DNA, 304 bp, mus musculus; identical to SEQ ID NO: 934
